US012480146B2

(12) United States Patent
Goettge et al.

(10) Patent No.: US 12,480,146 B2
(45) Date of Patent: *Nov. 25, 2025

(54) MICROBIAL PRODUCTION OF MOGROL AND MOGROSIDES

(71) Applicant: Manus Bio Inc., Cambridge, MA (US)

(72) Inventors: Michelle N. Goettge, Cambridge, MA (US); Ryan N. Philippe, Orleans (CA); Ajikumar Parayil Kumaran, Cambridge, MA (US); Christine Nicole S. Santos, Cambridge, MA (US); Jason Eric Donald, Cambridge, MA (US); Christopher Frei, Cambridge, MA (US); Aaron Love, Cambridge, MA (US); Kaitlin Chambers, Cambridge, MA (US); Joyce Samson, Cambridge, MA (US); Christopher Toomey, Cambridge, MA (US)

(73) Assignee: Manus Bio Inc., Cambridge, MA (US)

( * ) Notice: Subject to any disclaimer, the term of this patent is extended or adjusted under 35 U.S.C. 154(b) by 576 days.

This patent is subject to a terminal disclaimer.

(21) Appl. No.: 17/785,488

(22) PCT Filed: Dec. 16, 2020

(86) PCT No.: PCT/US2020/065285
§ 371 (c)(1),
(2) Date: Jun. 15, 2022

(87) PCT Pub. No.: WO2021/126960
PCT Pub. Date: Jun. 24, 2021

(65) Prior Publication Data
US 2023/0042171 A1 Feb. 9, 2023

Related U.S. Application Data

(60) Provisional application No. 63/075,631, filed on Sep. 8, 2020, provisional application No. 63/085,557, filed on Sep. 30, 2020, provisional application No. 62/948,657, filed on Dec. 16, 2019.

(51) Int. Cl.
*C12P 17/02* (2006.01)
*C12N 9/02* (2006.01)
*C12N 9/14* (2006.01)
*C12P 5/00* (2006.01)
*C12P 19/18* (2006.01)
*C12P 19/56* (2006.01)

(52) U.S. Cl.
CPC .......... *C12P 17/02* (2013.01); *C12N 9/0077* (2013.01); *C12N 9/14* (2013.01); *C12P 5/007* (2013.01); *C12P 19/18* (2013.01); *C12P 19/56* (2013.01); *C12Y 303/0201* (2013.01); *C12Y 504/99008* (2013.01)

(58) Field of Classification Search
CPC ...... C12N 9/0077; C12N 9/14; C12N 9/0083; C12N 9/1051; C12N 9/90; C12N 15/52; C12P 5/007; C12P 19/18; C12P 19/56; C12P 19/26; C12P 33/00; C12Y 303/0201; C12Y 504/99008; C12Y 114/99; C12Y 114/99034; C12Y 204/01017; C12Y 205/01021; C07K 14/415

See application file for complete search history.

(56) References Cited

U.S. PATENT DOCUMENTS

| | | | |
|---|---|---|---|
| 10,011,859 B2 * | 7/2018 | Liu | C12N 9/0071 |
| 10,480,015 B2 | 11/2019 | Kumaran et al. | |
| 10,633,685 B2 * | 4/2020 | Houghton-Larsen | C07H 1/06 |
| 10,662,442 B2 | 5/2020 | Kumaran et al. | |
| 10,774,314 B2 | 9/2020 | Donald et al. | |
| 10,774,346 B2 | 9/2020 | Kumaran et al. | |
| 11,060,124 B2 * | 7/2021 | Patron | C12P 33/20 |
| 11,339,412 B2 | 5/2022 | Kumaran et al. | |
| 11,352,648 B2 | 6/2022 | Kumaran et al. | |
| 2016/0319317 A1 | 11/2016 | Ono | |
| 2018/0070622 A1 | 3/2018 | Van Der Hoeven et al. | |
| 2018/0155734 A1 | 6/2018 | Guo et al. | |

(Continued)

FOREIGN PATENT DOCUMENTS

| | | | |
|---|---|---|---|
| WO | WO 2014/086842 A1 | 6/2014 | |
| WO | WO 2016/038617 A1 | 3/2016 | |

(Continued)

OTHER PUBLICATIONS

Banerjee et al., Improving enzymes for biomass conversion: A basic research perspective. Bioenerg. Res., 2010, vol. 3: 82-92. (Year: 2010).*

(Continued)

*Primary Examiner* — Ganapathirama Raghu
(74) *Attorney, Agent, or Firm* — Morgan, Lewis & Bockius LLP

(57) ABSTRACT

The present invention provides host cells and methods for making mogrol glycosides, including Mogroside V (Mog.V), Mogroside VI (Mog.VI), Iso-Mogroside V (Isomog.V), siamenoside, and glycosylation products that are minor products in Siraitia grosvenorii. The invention provides engineered enzymes and engineered host cells for producing mogrol glycosylation products, such as Mog.V, Mog.VI, and Isomog.V, at high purity and/or yield. The present technology further provides methods of making products containing mogrol glycosides, such as Mog.V, Mog.VI, and Isomog.V, including food products, beverages, oral care products, sweeteners, and flavoring products.

20 Claims, 32 Drawing Sheets

Specification includes a Sequence Listing.

(56) References Cited

U.S. PATENT DOCUMENTS

| | | | |
|---|---|---|---|
| 2018/0223264 A1 | 8/2018 | Vroom et al. | |
| 2021/0032669 A1* | 2/2021 | Philippe | C12N 9/1051 |

FOREIGN PATENT DOCUMENTS

| | | |
|---|---|---|
| WO | WO 2016/050890 A2 | 4/2016 |
| WO | WO 2019/169027 A2 | 9/2019 |

OTHER PUBLICATIONS

Broun et al., Catalytic plasticity of fatty acid modification enzymes underlying chemical diversity of plant lipids. Science, 1998, vol. 282: 1315-1317. (Year: 1998).*

Chica et al., Semi-rational approaches to engineering enzyme activity: combining the benefits of directed evolution and rational design. Curr. Opi. Biotechnol., 2005, vol. 16: 378-384. (Year: 2005).*

Li et al., A structural and data-driven approach to engineering plant cytochrome P450 enzyme. Science China., 2019, vol. 62(7): 873-882. (Year: 2019).*

Rahimi et al., Triterpenoid-biosynthetic UDP-glycosyltransferase from plants. Biotechnol. Advances., 2019, vol. 37: 107394, pp. 1-18. (Year: 2019).*

Seffernick et al., Melamine deaminase and Atrazine chlorohydrolase: 98 percent identical but functionally different. J. Bacteriol., 2001, vol. 183 (8): 2405-2410. (Year: 2001).*

Sen et al., Developments in directed evolution for enzyme functions. Appl. Biochem. Biotechnol., 2007, vol. 143: 212-223. (Year: 2007).*

Qiao et al., Identification of a novel specific cucurbitadienol synthase allele in Siraitia grosvenorii correlates with high catalytic activity. Molecules, 2019, vol. 79: 49-63. (Year: 2019).*

Whisstock et al., Prediction of protein function from protein sequence. Q. Rev. Biophysics., 2003, vol. 36 (3): 307-340. (Year: 2003).*

Witkowski et al., Conversion of b-ketoacyl synthase to a Malonyl Decarboxylase by replacement of the active cysteine with glutamine. Biochemistry, 1999, vol. 38: 11643-11650. (Year: 1999).*

Devos et al., Practical limits of function prediction. Proteins: Structure, Function, and Genetics. 2000, vol. 41: 98-107. (Year: 2000).*

Badouin, et al., "The sunflower genome provides insights into oil metabolism, flowering and Asterid evolution," Nature, 2017, vol. 546, 14 pgs.

International Search Report and Written Opinion of corresponding International Application No. PCT/US20/065285 dated May 6, 2021. 13 pages.

Genpept, "cytochrome P450 87A3-like [*Cucurbita pepo* subsp. pepo]," NCBI Reference Sequence: XP_023542446.1.

Itkin, et al., "The biosynthetic pathway of the nonsugar, high-intensity sweetener morgroside V from *Siraitia grosvenorii*," PNAS, Nov. 7, 2016, pp. E7619-E7628.

Itkin, et al., Correction "The biosynthetic pathway of the nonsugar, high-intensity sweetener morgroside V from *Siraitia grosvenorii*," PNAS, Apr. 2, 2018, 1 page.

* cited by examiner

```
Enzyme 1    ---MENHATFNVLMLPWLAHGHVSPYLELAKKLTARNFNVYLCSSPATLSSVRSKLTEKF  57
Enzyme 2    MDAAQQGOTTTILMLPWLGYGHLSAFLELAKSLSRRNFHIYFCSTSVNLDAIKPKLPSSF  60
               ::  * .:******.:**:* :*****.*: ***::*:**:  ..*.:::  ** ..*

Enzyme 1    SQSIHLVELMLPKLPELPAEYHTTNGLPPHLMPTLKDAPOMAKPNFCNVLKSLKPOLLIY  117
Enzyme 2    SDSIQFVELHLPSSPEFPPHLHTTNGLPPTLMPALHQAFSMAAQHFESILQTLAPHLLIY  120
            *:**::****** .**:* .********* ***:*::**.**  :*...:*::* *.****

Enzyme 1    DLLQPNAPEAASAFNIPAVVFISSSATMTSFGLMFFKNPGTKYPYGNAIFYRDYESVFVE  177
Enzyme 2    DSLQPNAPRVASSLKIPAIMPNTTGVFVISQGXMPIHYPHSKFPFSEFVLMNMWKAMYST  180
            * ****** .**::::***: *  :::. : * *   *  :: * :*:*:.. :::.:::::

Enzyme 1    NL----TRRDRDTYRVINCMERSSKIILIKGFNEIEGKYFDYFSCLTGKKVVPVGPLVQO  233
Enzyme 2    ADGASTERTRKWGEAFLYCLMASCSVILINSFRELEGKYMDYLSVLLNKKVVPVGPLVVE  240
                  *   .:  *:. *  .:***.:*.*:****:**:* * .********** :

Enzyme 1    PVLDDED---CRIMQNLNKKEKGSTVFVSFGSEYFLSKKDNEEIAHGLEVSNVDFIWVVK  290
Enzyme 2    PNQDGEDEGYSSIKNWLDKKEPSSTVFVSFGSEYFPSKEENEEIAMGLEASEVNFIWVVR  300
            *  *.**   . *.:**.*** .************ **::******* *:*.******

Enzyme 1    FPKGENI-VIEETLPKGFFERVGERGLVVNGWAPQAKILTHPKVGGFVSHCGWNSVMESM  349
Enzyme 2    FPQGDNTSGIEDALPNGFLERAGERGMVVKGMAPQAKILKHWSTGGFVSHCGMNSVMESM  360
            **:*:*   **::*****.**** ****:** *********.*  .. ******* ******

Enzyme 1    KFGLPILAMPMHLOQPINARLIEEVGAGVEVLRDSKGKLMRERMAETINKVMKEASGESV  409
Enzyme 2    MFGVPIIGVPMHVOQPFNAGLVEEAGVGVEAKRDPDGKIQRDEVAKLIKEVVVEKTREDV  420
             **:***..:***:***:** *.*** *.***  ** .**::*..:*: *::*: * : *

Enzyme 1    RKKARELQEKLELKGDEEIDDVVKELVQLCATKNKRNGLHYY  451
Enzyme 2    RKKAREMSEILRSKGEEKFDEMVAEISLLLKI----------  452
            ******:.* *.  **:*::::* *:  *
```

FIG. 27

```
Enzyme 1  -MEFVKCLGHPEEFYNLVRFRIGGKRKVMPKMDQDSLSSSLKTCYKYLNQTSRSFAAVIQ  59
Enzyme 2  MSSLKAVLKHPDDFYPLLKLKMAAKKAEKQIP----SQPHWAFSYSMLHKVSRSFALVIQ  56
           ,:  * **,,** *,::::,*;     ,   *. *,,,***** ***

Enzyme 1  ALDGEMRNAVCIFYLVLRALDTLEDDMTISVEKKVPLLHNFHSFLYQPDWRFMESKEKDR 119
Enzyme 2  QLNPQLRDAVCIFYLVLRALDTVEDDTSIAADIKVPILIAFHKHIYNRDWHFACGTKEYK 116
           *;  ;;*,**************,***  ,*,  ;  ***,*   **  ,,*;  **,*    ..;;  ;

Enzyme 1  QVLEDFPTISLEFRNLAEKYQTVIADICRRMGIGMAEFLDKHVTSEQEWDKYCHYVAGLV 179
Enzyme 2  VLMDQFHHVSTAFLELKRGYQEAIEDITMRMGAGMAKFICKEVETVDDYDEYCHYVAGLV 176
           ;:;:*  ,*  ,* ,*  ,  ** , ** *** ***,*; *,*  ; ,;;*,*******

Enzyme 1  GIGLSRLFSASEFEDPLVGEDTERANSMGLFLQKTNIIRDYLEDQQ---GGREFWPQEVW 236
Enzyme 2  GIGLSKLFHSSGTEILF---SDSISNSMGLFLQKTNIIRDYLEDINEIPKSRMFWPREIW 233
          *****,** ,*   *   ;    , ,; ,********************  ;    * ***,*,*

Enzyme 1  SRYVKKLGDFAKPENIDLAVQCLNELITNALHHIPDVITYLSRLRNQSVFNFCAIPQVMA 296
Enzyme 2  SKYVNKLEDLKYEENSEKAVQCLNDMVTNALIHIEDCLKYMSQLKDPAIFRFCAIPQIMA 293
          *,**,** *,   **  ;  *******,,,**** **  *  ;,,*,*;;  ;;* ,******,**

Enzyme 1  IATLAACYNNQQVFKGAVKIRKGQAVTLMMDATNMPAVKAIIYQYMEEIYHRIPDSDPSS 356
Enzyme 2  IGTLALCYNNIEVFRGVVKLRRGLTAKVIDRTKTMADVYQAFSDFSDMLKSKVDMHDPNA 353
          * *** ****  ,**,* **,*,* ;;;   ,,,;  ,,,*   *     ; ;; ; ;;  **.;

Enzyme 1  SKTRQIISTIRT--------QNLPNCQLISRSHYSPIYLSFVMLLAALSWQYLTTLSQVT 408
Enzyme 2  QTTITRLEAAQKICKDSGTLSNRKSYIVKRESSYSAALLALLFTILAILYAYLSANRPNK 413
          ,,*  ;,;;,    *   , ,;  ;  .** *,::: ; *,; ; **;;    .

Enzyme 1  EDYVQTGEH    417
Enzyme 2  IKFTL----    418
           .:.
```

FIG. 28

```
Enzyme 1  MLEFHFEGEEQPLSMMKKFLKSSWVRIGFVPEEERNVLRRRKGTNISETSLIGTAACTST  60
Enzyme 2  ------------------------------------------------------------   0

Enzyme 1  SSQNDPEVIIVGAGVLGSALAAVLSRDGRKVTVIERDLKEPDRIVGEFLQPGGYHVLKDL 120
Enzyme 2  -MKEEFDICIIGAGMAGATISAYLAPKGIKIALIDHCYKEKKRIVGELLQPGAVLSLEQM  59
           ::: ::  *:***: *::::* *: ,* *:::*::  ** ,*****,****,   *:;

Enzyme 1  GLGDTVEGLDAQVVNGYMIHDQESKSEVQIPYPLSENNQVQSGRAFHHGRFIMSLRKAAM 180
Enzyme 2  GLSHLLDGFEAQTVKGYALLQGNEKT--TIPYPSQ-----HEGIGLHNGRFLQQIRASAL 112
          **,,  ::**::** *,*,   : : ,*;    ****  ,    :,* ,:*:***; :* :*:

Enzyme 1  AEPNAKFIEGVVLQLLEE-DDVVMGVQYKDKETGDIKELHAPLTVVADGLFSKFRKSLVS 239
Enzyme 2  ENSSVTQIHGKALQLLENERNEIIGVSYRESITSQIKSIYAPLTITSDGFFSNFRAHLSN 172
           : ... *.* ***;  ; ::.*:,  *,: ,;;,;: * , Enzyme 1  NKVSVSSHFVGFLMKNAPQFKANHAELILANPSPVLIYQISSSETRVLVDIRGEMPR--- 296
Enzyme 2  NQKTVTSYFIGLILKDCEMPFPKHGHVFLSGPTPFICYPISDNEVRLLIDFPGEQLPRKN 232
          *; ,*:*:*:*::*:  *   ..:*  *,:.*:*, :* **  ,* *:,*:,*; **

Enzyme 1  NLREYMVEKIYPQIPDHLKEPFLEATDNSHLRSMPASFLPPSSVKKRGVLLLGDAYNMRH 356
Enzyme 2  LLQEHLDTNVTPYIPECMRSSYAQAIQEGGFKVMPNHYMAAKPIVRKGAVMLGDALNMRH 292
          *;*:; :: * **:  :, ; *  :;;  :**  :: *   . : ::*.::**** ****

Enzyme 1  PLTGGGMTVAFKDIKLWRKLLKGIPDLYDDAAIFEAKKSFYWARKTSHSFVVNILAQALY 416
Enzyme 2  PLTGGGLTAVFSDIQILSAHLLAMPDFKNTDLIHEKIEAYYRDRKR-ANANLNILANALY 351
          ******,* ,,* **,;   *  :**;   * ,:**; : *,* **    ,.****,***

Enzyme 1  ELFSATDDSLHQLRKACFLYFKLGGECVAGPVGLLSVLSPNPLVLIGHFFAVAIYAVYFC 476
Enzyme 2  AVMSN-----DLLKTAVFKYLQCGGANAQESIAVLAGLNRKHFSLIKQFCFLAVFGACNL 406
           ::*       ,*::,* * *:: ** ,  :::*;,*,,,  ** :* .*:;  .*:..

Enzyme 1  FKSEPWITKPRALLSSGAVLYKACSVIFPLIYSEMKYMVH     516
Enzyme 2  LQQ-SISNIPKAL----KLLKDAFVIIKPLIKNELS----     437
          :::  *,**   ,*  *  *** *,:           
```

MICROBIAL PRODUCTION OF MOGROL AND MOGROSIDES

CROSS-REFERENCE TO RELATED APPLICATIONS

This application claims priority to, and the benefit of, U.S. Provisional Application No. 63/085,557 filed Sep. 30, 2020, U.S. Provisional Application No. 63/075,631 filed Sep. 8, 2020, and U.S. Provisional Application No. 62/948,657 filed Dec. 16, 2019, the disclosures of which are hereby incorporated by reference in their entireties.

SEQUENCE LISTING

The instant application contains a sequence listing, which has been submitted ASCII format. Said ASCII copy, created about Mar. 12, 2025 is named "MAN-025PC_SEQUENCE-_LISTING_ST25," and is 934,434 bytes in size, the contents of which are incorporated herein by reference in their entirety.

BACKGROUND

Mogrosides are triterpene-derived specialized secondary metabolites found in the fruit of the Cucurbitaceae family plant *Siraitia grosvenorii* (a/k/a monkfruit or Luo Han Guo). Their biosynthesis in fruit involves a number of consecutive glycosylations of the aglycone mogrol. The food industry is increasing its use of mogroside fruit extract as a natural non-sugar food sweetener. For example, mogroside V (Mog.V) has a sweetening capacity that is ~250 times that of sucrose (Kasai et al., *Agric Biol Chem* (1989)). Moreover, additional health benefits of mogrosides have been revealed in recent studies (Li et al., *Chin J Nat Med* (2014)).

A variety of factors are promoting a surge in interest in research and commercialization of the mogrosides and monkfruit in general, including, for example, the explosion in popularity of and demand for natural sweeteners; the difficulties in scalable sourcing of other promising natural sweeteners such as rebaudioside M (RebM) from the *Stevia* plant; the superior taste performance of Mog.V relative to other natural and artificial sweetener products on the market; and the medicinal potential of the plant and fruit.

Purified Mog.V has been approved as a high-intensity sweetening agent in Japan (Jakinovich et al., *Journal of Natural Products* (1990)) and the extract has gained GRAS status in the USA as a non-nutritive sweetener and flavor enhancer (GRAS 522). Extraction of mogrosides from the fruit can yield a product of varying degrees of purity, often accompanied by undesirable aftertaste. In addition, yields of mogroside from cultivated fruit are limited due to low plant yields and particular cultivation requirements of the plant. Mogrosides are present at about 1% in the fresh fruit and about 4% in the dried fruit (Li H B, et al., 2006). Mog.V is the main component, with a content of 0.5% to 1.4% in the dried fruit. Moreover, purification difficulties limit purity for Mog.V, with commercial products from plant extracts being standardized to about 50% Mog.V. It is highly likely that a pure Mog.V product will achieve greater commercial success than the blend, since it is less likely to have off flavors, will be easier to formulate into products, and has good solubility potential. It is therefore advantageous to be able to produce sweet mogroside compounds via biotechnological processes.

SUMMARY

The present invention, in various aspects and embodiments, provides enzymes (including engineered enzymes), microbial strains, and methods for making mogrol and mogrol glycosides ("mogrosides") using recombinant microbial processes. In other aspects, the invention provides methods for making products, including foods, beverages, and sweeteners (among others), by incorporating the mogrol glycosides produced according to the present disclosure.

In various aspects, the invention provides microbial strains and methods for making mogrol or mogrol glycoside(s). The invention involves a recombinant microbial host cell expressing a heterologous enzyme pathway catalyzing the conversion of isopentenyl pyrophosphate (IPP) and/or dimethylallyl pyrophosphate (DMAPP) to mogrol or mogrol glycoside(s). The microbial host cell in various embodiments may be prokaryotic (e.g., *E. coli*) or eukaryotic (e.g., yeast).

In various embodiments, the heterologous enzyme pathway comprises a farnesyl diphosphate synthase (FPPS) and a squalene synthase (SQS), which are recombinantly expressed. In various embodiments, the SQS comprises an amino acid sequence that is at least 70% identical to an amino acid sequence selected from SEQ ID NOS: 2 to 16, 166, and 167. In some embodiments, the SQS comprises an amino acid sequence that is at least 70% identical to SQS (SEQ ID NO: 11), which has high activity in *E. coli*.

In some embodiments, the host cell expresses one or more enzymes that produce mogrol from squalene. For example, the host cell may express one or more squalene epoxidase (SQE) enzymes, one or more triterpenoid cyclases, an epoxide hydrolase (EPH), one or more cytochrome P450 oxidase enzymes (CYP450), a non-heme iron-dependent oxygenases, and a cytochrome P450 reductases (CPR). As shown in FIG. 2, the heterologous pathway can proceed through several routes to mogrol, which may involve one or two epoxidations of the core substrate.

In some embodiments, the heterologous enzyme pathway comprises two squalene epoxidase (SQE) enzymes. For example, the heterologous enzyme pathway may comprise an SQE that produces 2,3-oxidosqualene. In some embodiments, the SQE will produce 2,3:22,23-dioxidosqualene, and this conversion can be catalyzed by the same SQE enzyme, or an enzyme that differs in amino acid sequence by at least one amino acid modification. For example, the squalene epoxidase enzymes may include at least two SQE enzymes each comprising (independently) an amino acid sequence that is at least 70% identical to any one of SEQ ID NOS: 17 to 39, 168 to 170, and 177 to 183.

In some embodiments, at least one SQE comprises an amino acid sequence that is at least 70% identical to SEQ ID NO: 39.

In some embodiments, the host cell comprises two squalene epoxidase enzymes that each comprise an amino acid sequence that is at least 70% identical to squalene epoxidase (SEQ ID NO: 39). For example, one of the SQE enzymes may have one or more amino acid modifications that improve specificity or productivity for conversion of 2,3-oxidosqualene to 2,3:22,23 dioxidosqualene, as compared to the enzyme having the amino acid sequence of SEQ ID NO: 39. In some embodiments, the amino acid modifications comprise one or more modifications at positions corresponding to the following positions of SEQ ID NO: 39: 35, 133, 163, 254, 283, 380, and 395. For example, the amino acid at the position corresponding to position 35 of SEQ ID NO: 39 may be arginine (e.g., H35R). The position corresponding to position 133 of SEQ ID NO 39 may be glycine (e.g., N133G). The amino acid at the position corresponding to position 163 of SEQ ID NO: 39 may be alanine (e.g., F163A). The amino acid at the position corresponding to position 254 of SEQ ID NO: 39 may be phenylalanine (e.g., Y254F). The amino acid at the position corresponding to position 283 of SEQ ID NO: 39 may be leucine (e.g., M283L). The amino acid at the position corresponding to position 380 of SEQ ID NO: 39 may be leucine (e.g., V280L). The amino acid at the position corresponding to position 395 of SEQ ID NO: 39 may be tyrosine (e.g., F395Y).

In various embodiments, the heterologous enzyme pathway comprises a triterpene cyclase (TTC) enzyme. In some embodiments, where the microbial cell coexpresses FPPS, along with the SQS, SQE, and one or more triterpene cyclase enzymes, the microbial cell produces 2,3;22,23-dioxidosqualene. The 2,3;22,23-dioxidosqualene may be the substrate for downstream enzymes in the heterologous pathway. In some embodiments, the triterpene cyclase (TTC) comprises an amino acid sequence that is at least 70% identical to an amino acid sequence selected from SEQ ID NOS: 40 to 55 and 191 to 193. The TTC in various embodiments comprises an amino acid sequence that is at least 70% identical to the amino acid sequence of SEQ ID NO: 40.

In various embodiments, the heterologous enzyme pathway comprises at least two copies of a TTC enzyme gene, or comprises at least two enzymes having triterpene cyclase activity and converting 22,23-dioxidosqualene to 24,25-epoxycucurbitadienol. In such embodiments, product can be pulled to 24,25-epoxycucurbitadienol, with less production of cucurbitadienol. In some embodiments, the heterologous enzyme pathway comprises at least one TTC that comprises an amino acid sequence that is at least 70% identical to one of SEQ ID NO: 191, SEQ ID NO: 192, and SEQ ID NO: 193. For example, when co-expressed with SgCDS, these enzymes demonstrated improved production of 24,25-epoxycucurbitadienol compared to expression of SgCDS alone.

In some embodiments, the heterologous enzyme pathway comprises an epoxide hydrolase (EPH). The EPH may comprise an amino acid sequence that is at least 70% identical to amino acid sequence selected from SEQ ID NOS: 56 to 72, 184 to 190, and 212. In some embodiments, the EPH may employ as a substrate 24,25-epoxycucurbitadienol, for production of 24,25-dihydroxycucurbitadienol In some embodiments, the heterologous pathway comprises at least one EPH converting 24,25-epoxycucurbitadienol to 24,25-dihydroxycucurbitadienol, the at least one EPH comprising an amino acid sequence that is at least 70% identical to one of: SEQ ID NO: 189, SEQ ID NO: 58, SEQ ID NO: 184, SEQ ID NO: 185, SEQ ID NO: 187, SEQ ID NO: 188, SEQ ID NO: 190, and SEQ ID NO: 212.

In some embodiments, the heterologous pathway comprises one or more oxidases. The one or more oxidases may be active on cucurbitadienol or oxygenated products thereof as a substrate, adding (collectively) hydroxylations at C11, C24 and 25, thereby producing mogrol. Alternatively or in addition, the heterologous pathway may comprise one or more oxidases that oxidize C11 of C24,25 dihydroxycucurbitadienol to produce mogrol.

In some embodiments, at least one oxidase is a cytochrome P450 enzyme. Exemplary cytochrome P450 enzymes comprise an amino acid sequence that is at least 70% identical to an amino acid sequence selected from SEQ ID NOS: 73 to 91, 171 to 176, and 194 to 200.

In some embodiments, the microbial host cell expresses a heterologous enzyme pathway comprising a P450 enzyme having activity for oxidation at C11 of C24,25 dihydroxycucurbitadienol, to thereby produce mogrol. For example, in some embodiments, the cytochrome P450 comprises an amino acid sequence that is at least 70% identical to an amino acid sequence selected from SEQ ID NO: 194 and SEQ ID NO: 171.

In various embodiments, the microbial host cell expresses one or more electron transfer proteins selected from a cytochrome P450 reductase (CPR), flavodoxin reductase (FPR) and ferredoxin reductase (FDXR) sufficient to regenerate the one or more oxidases. Exemplary CPR proteins are provided herein as SEQ ID NOS: 92 to 99 and 201.

In some embodiments, the microbial host cell expresses SEQ ID NO: 194 or a derivative thereof, and SEQ ID NO: 98 or a derivative thereof. In some embodiments, the microbial host cell expresses SEQ ID NO: 171 or a derivative thereof, and SEQ ID NO. 201 or a derivative thereof.

In some embodiments, the heterologous enzyme pathway further comprises one or more uridine diphosphate-dependent glycosyltransferase (UGT) enzymes, thereby producing one or more mogrol glycosides. The mogrol glycoside may be pentaglycosylated, hexaglycosylated, or more, in some embodiments. In other embodiments, the mogrol glycoside has two, three, or four glucosylations. The one or more mogrol glycosides may be selected from Mog.II-E, Mog.III, Mog.III-A1, Mog.III-A2, Mog.II, Mog.IV, Mog.IV-A, siamenoside, Mog.V, and Mog.VI. In some embodiments, the host cell produces Mog.V or siamenoside.

In some embodiments, the host cell expresses a UGT enzyme that catalyzes the primary glycosylation of mogrol at C24 and/or C3 hydroxyl groups. In some embodiments, the UGT enzyme catalyzes a branching glycosylation, such as a beta 1,2 and/or beta 1,6 branching glycosylation at the primary C3 and C24 glucosyl groups.

In some embodiments, at least one UGT enzyme comprises an amino acid sequence that is at least 70% identical to an amino acid sequence selected from SEQ ID NOS: 116 to 165, 202 to 210, 211, and 213 to 218.

For example, in some embodiments, the microbial cell expresses at least four UGT enzymes, resulting in glucosylation of mogrol at the C3 hydroxyl group, the C24 hydroxyl group, as well as a further 1,6 glucosylation at the C3 glucosyl group, and a further 1,6 glucosylation and a further 1,2 glucosylation at the C24 glucosyl group. The product of such glucosylation reactions is Mog.V.

In some embodiments, at least one UGT enzyme comprises an amino acid sequence having at least 70% sequence identity to one of SEQ ID NO: 164, 165, 138, 204 to 211, and 213 to 218. In some embodiments, the UGT enzyme is engineered to have higher glycosyltransferase productivity as compared to the wild type enzyme.

In various embodiments, the microbial strain expresses one or more UGT enzymes capable of primary glycosylation at C24 and/or C3 of mogrol. Exemplary UGT enzymes include UGT enzymes comprising: an amino acid sequence that is at least 70% identical to SEQ ID NO: 165, an amino acid sequence that is at least 70% identical to SEQ ID NO: 146, an amino acid sequence that is at least 70% identical to SEQ ID NO. 202, an amino acid sequence that is at least 70% identical to SEQ ID NO: 202, an amino acid sequence that is at least 70% identical to SEQ ID NO: 129, an amino acid sequence that is at least 70% identical to SEQ ID NO: 116, an amino acid sequence that is at least 70% identical to SEQ ID NO: 218, and amino acid sequence that is at least 70% identical to SEQ ID NO: 217.

In various embodiments, the microbial strain expresses one or more UGT enzymes capable of catalyzing a branching glycosylation of one or both primary glycosylations. Such UGT enzymes are summarized in Table 2.

In some embodiments, the microbial host cell has one or more genetic modifications that increase the production of UDP-glucose, the co-factor employed by UGT enzymes.

Mogrol glycosides can be recovered from the microbial culture. For example, mogrol glycosides may be recovered from microbial cells, or in some embodiments, are predominately available in the extracellular media, where they may be recovered or sequestered.

Other aspects and embodiments of the invention will be apparent from the following detailed disclosure.

DESCRIPTION OF THE FIGURES

FIG. 26 is an amino acid alignment of CaUGT_1,6 (SEQ ID NO: 164) and SgUGT94_289_3 (SEQ ID NO: 117) using Clustal Omega (Version CLUSTAL O (1,2,4). These sequences share 54% amino acid identity.

FIG. 27 is an amino acid alignment of *Homo sapiens* squalene synthase (HsSQS) (NCBI accession NP_004453.3, SEQ ID NO: 222) and AaSQS (SEQ ID NO: 11) using Clustal Omega (Version CLUSTAL O (1.2.4)). HsSQS has a published crystal structure (PDB entry: 1EZF). These sequences share 42% amino acid identity.

FIG. 28 is an amino acid alignment of *Homo sapiens* squalene epoxidase (HsSQE) (NCBI accession XP_011515548, SEQ ID NO: 223) and MlSQE (SEQ ID NO: 39) using Clustal Omega (Version CLUSTAL O (1.2.4)). HsSQE has a published crystal structure (PDB entry: 6C6N). These sequences share 35% amino acid identity.

DETAILED DESCRIPTION OF THE INVENTION

Figure 1:
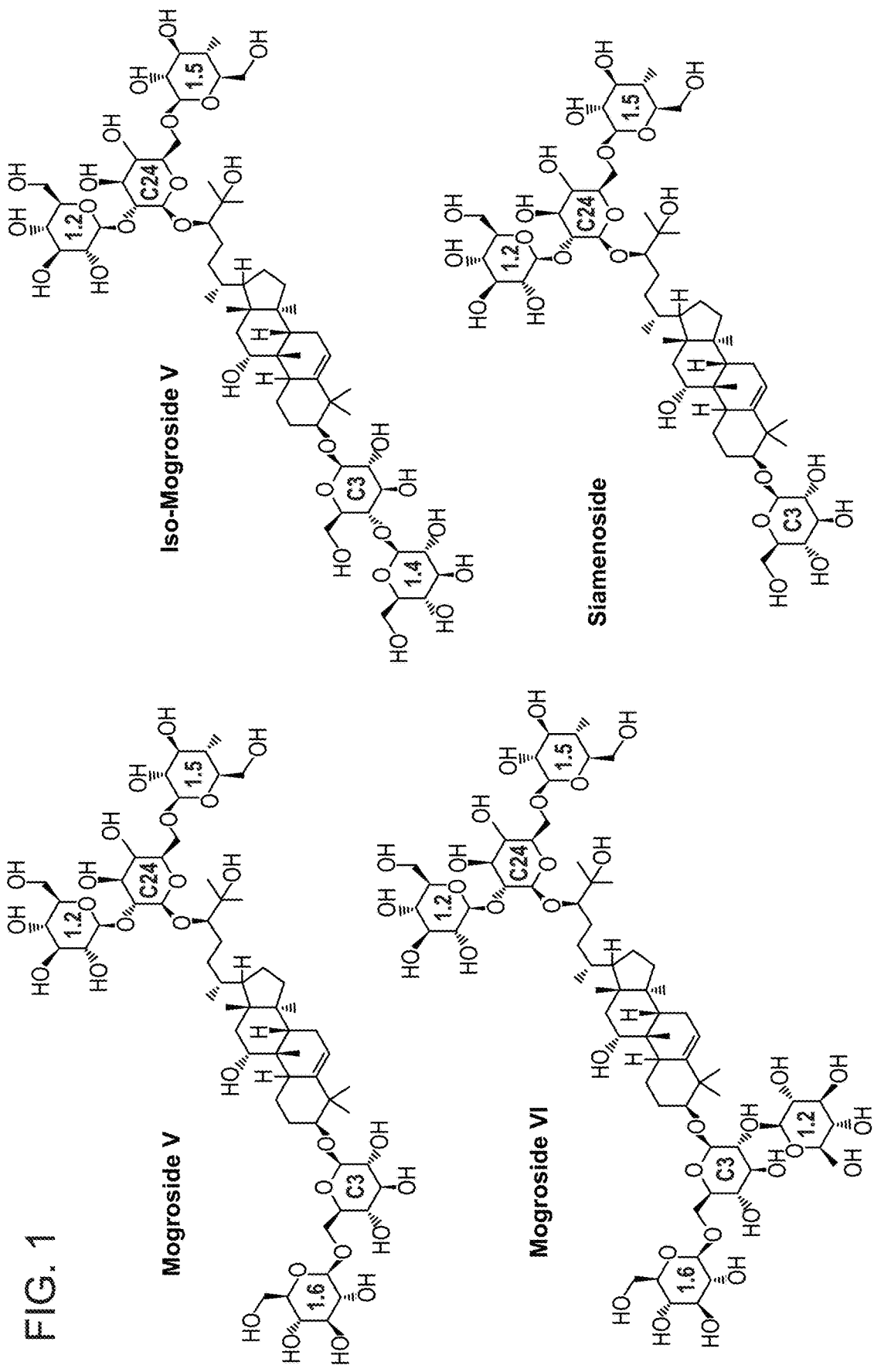
FIG. 1 shows the chemical structures of Mog.V, Mog.VI, Isomog.V, and Siamenoside. The type of glycosylation reaction is shown within each glucose moiety (e.g., C3 or C24 core glycosylation and the 1-2, 1-4, or 1-6 glycosylation additions).

The present invention, in various aspects and embodiments, provides microbial strains and methods for making mogrol and mogrol glycosides, using recombinant microbial processes. In other aspects, the invention provides methods for making products, including foods, beverages, and sweeteners (among others), by incorporating the mogrol glycosides produced according to the methods described herein. In still other aspects, the invention provides engineered UGT enzymes for glycosylating secondary metabolite substrates, such as mogrol or mogrosides.

As used herein, the terms "terpene or triterpene" are used interchangeably with the terms "terpenoid" or "triterpenoid," respectively.

In various aspects, the invention provides microbial strains and methods for making the triterpenoid compound mogrol, or glycoside products thereof. The invention provides a recombinant microbial host cell expressing a heterologous enzyme pathway catalyzing the conversion of isopentenyl pyrophosphate (IPP) and/or dimethylallyl pyrophosphate (DMAPP) to one or more of mogrol or mogroside(s).

The microbial host cell in various embodiments may be prokaryotic or eukaryotic. In some embodiments, the microbial host cell is a bacterium, and which can be optionally selected from Escherichia spp., Bacillus spp., Corynebacterium spp., Rhodobacter spp., Zymomonas spp., Vibrio spp., and Pseudomonas spp. For example, in some embodiments, the bacterial host cell is a species selected from Escherichia coli, Bacillus subtilis, Corynebacterium glutamicum, Rhodobacter capsulatus, Rhodobacter sphaeroides, Zymomonas mobilis, Vibrio natriegens, or Pseudomonas putida. In some embodiments, the bacterial host cell is E. coli. Alternatively, the microbial cell may be a yeast cell, such as but not limited to a species of Saccharomyces, Pichia, or Yarrowia, including Saccharomyces cerevisiae, Pichia pastoris, and Yarrowia lipolytica.

The microbial cell will produce MEP or MVA products, which act as substrates for the heterologous enzyme pathway. The MEP (2-C-methyl-D-erythritol 4-phosphate) pathway, also called the MEP/DOXP (2-C-methyl-D-erythritol 4-phosphate/l-deoxy-D-xylulose 5-phosphate) pathway or the non-mevalonate pathway or the mevalonic acid-independent pathway refers to the pathway that converts glyceraldehyde-3-phosphate and pyruvate to IPP and DMAPP. The pathway, which is present in bacteria, typically involves action of the following enzymes: 1-deoxy-D-xylulose-5-phosphate synthase (Dxs), 1-deoxy-D-xylulose-5-phosphate reductoisomerase (IspC), 4-diphosphocytidyl-2-C-methyl-D-erythritol synthase (IspD), 4-diphosphocytidyl-2-C-methyl-D-erythritol kinase (IspE), 2C-methyl-D-erythritol 2,4-cyclodiphosphate synthase (IspF), 1-hydroxy-2-methyl-2-(E)-butenyl 4-diphosphate synthase (IspG), and isopentenyl diphosphate isomerase (IspH). The MEP pathway, and the genes and enzymes that make up the MEP pathway, are described in U.S. Pat. No. 8,512,988, which is hereby incorporated by reference in its entirety. For example, genes that make up the MEP pathway include dxs, ispC, ispD, ispE, ispF, ispG, ispH, idi, and ispA. In some embodiments, the host cell expresses or overexpresses one or more of dxs, ispC, ispD, ispE, ispF, ispG, ispH, idi, ispA, or modified variants thereof, which results in the increased production of IPP and DMAPP. In some embodiments, the triterpenoid (e.g., squalene, mogrol, or other intermediate described herein) is produced at least in part by metabolic flux through an MEP pathway, and wherein the host cell has at least one additional gene copy of one or more of dxs, ispC, ispD, ispE, ispF, ispG, ispH, idi, ispA, or modified variants thereof.

The MVA pathway refers to the biosynthetic pathway that converts acetyl-CoA to IPP. The mevalonate pathway, which will be present in yeast, typically comprises enzymes that catalyze the following steps: (a) condensing two molecules of acetyl-CoA to acetoacetyl-CoA (e.g., by action of acetoacetyl-CoA thiolase); (b) condensing acetoacetyl-CoA with acetyl-CoA to form hydroxymethylglutaryl-CoenzymeA (HMG-CoA) (e.g., by action of HMG-CoA synthase (HMGS)); (c) converting HMG-CoA to mevalonate (e.g., by action of HMG-CoA reductase (HMGR)); (d) phosphorylating mevalonate to mevalonate 5-phosphate (e.g., by action of mevalonate kinase (MK)); (e) converting mevalonate 5-phosphate to mevalonate 5-pyrophosphate (e.g., by action of phosphomevalonate kinase (PMK)); and (f) converting mevalonate 5-pyrophosphate to isopentenyl pyrophosphate (e.g., by action of mevalonate pyrophosphate decarboxylase (MPD)). The MVA pathway, and the genes and enzymes that make up the MVA pathway, are described in U.S. Pat. No. 7,667,017, which is hereby incorporated by reference in its entirety. In some embodiments, the host cell expresses or overexpresses one or more of acetoacetyl-CoA thiolase, HMGS, HMGR, MK, PMK, and MPD or modified variants thereof, which results in the increased production of IPP and DMAPP. In some embodiments, the triterpenoid (e.g., mogrol or squalene) is produced at least in part by metabolic flux through an MVA pathway, and wherein the host cell has at least one additional gene copy of one or more of acetoacetyl-CoA thiolase, HMGS, HMGR, MK, PMK, MPD, or modified variants thereof.

In some embodiments, the host cell is a bacterial host cell engineered to increase production of IPP and DMAPP from glucose as described in U.S. Pat. Nos. 10,480,015 and 10,662,442, the contents of which are hereby incorporated by reference in their entireties. For example, in some embodiments the host cell overexpresses MEP pathway enzymes, with balanced expression to push/pull carbon flux to IPP and DMAP. In some embodiments, the host cell is engineered to increase the availability or activity of Fe—S cluster proteins, so as to support higher activity of IspG and IspH, which are Fe—S enzymes. In some embodiments, the host cell is engineered to overexpress IspG and IspH, so as to provide increased carbon flux to 1-hydroxy-2-methyl-2-(E)-butenyl 4-diphosphate (HMBPP) intermediate, but with balanced expression to prevent accumulation of HMBPP at an amount that reduces cell growth or viability, or at an amount that inhibits MEP pathway flux and/or terpenoid production. In some embodiments, the host cell exhibits higher activity of IspH relative to IspG. In some embodiments, the host cell is engineered to downregulate the ubiquinone biosynthesis pathway, e.g., by reducing the expression or activity of IspB, which uses IPP and FPP substrate.

In various embodiments, the heterologous enzyme pathway comprises a farnesyl diphosphate synthase (FPPS) and a squalene synthase (SQS), which are recombinantly expressed. In various embodiments, the SQS comprises an amino acid sequence that is at least 70% identical to an amino acid sequence selected from SEQ ID NOS: 2 to 16, 166, and 167.

By way of non-limiting example, the FPPS may be Saccharomyces cerevisiae farnesyl pyrophosphate synthase (ScFPPS)(SEQ ID NO: 1), or modified variants thereof. Modified variants may comprise an amino acid sequence that is at least 70% identical to SEQ ID NO: 1). For example, the FPPS may comprise an amino acid sequence that is at least 80%, or at least 85%, or at least 90%, or at least 95%, or at least 98%, or at least 99% identical to SEQ ID NO: 1. In some embodiments, the FPPS comprises an amino acid sequence having from 1 to 20 amino acid modifications or having from 1 to 10 amino acid modifications with respect to SEQ ID NO: 1, the amino acid modifications being independently selected from amino acid substitutions, deletions, and insertions. Numerous other FPPS enzymes are known in the art, and may be employed for conversion of IPP and/or DMAPP to farnesyl diphosphate in accordance with this aspect.

Figure 5:
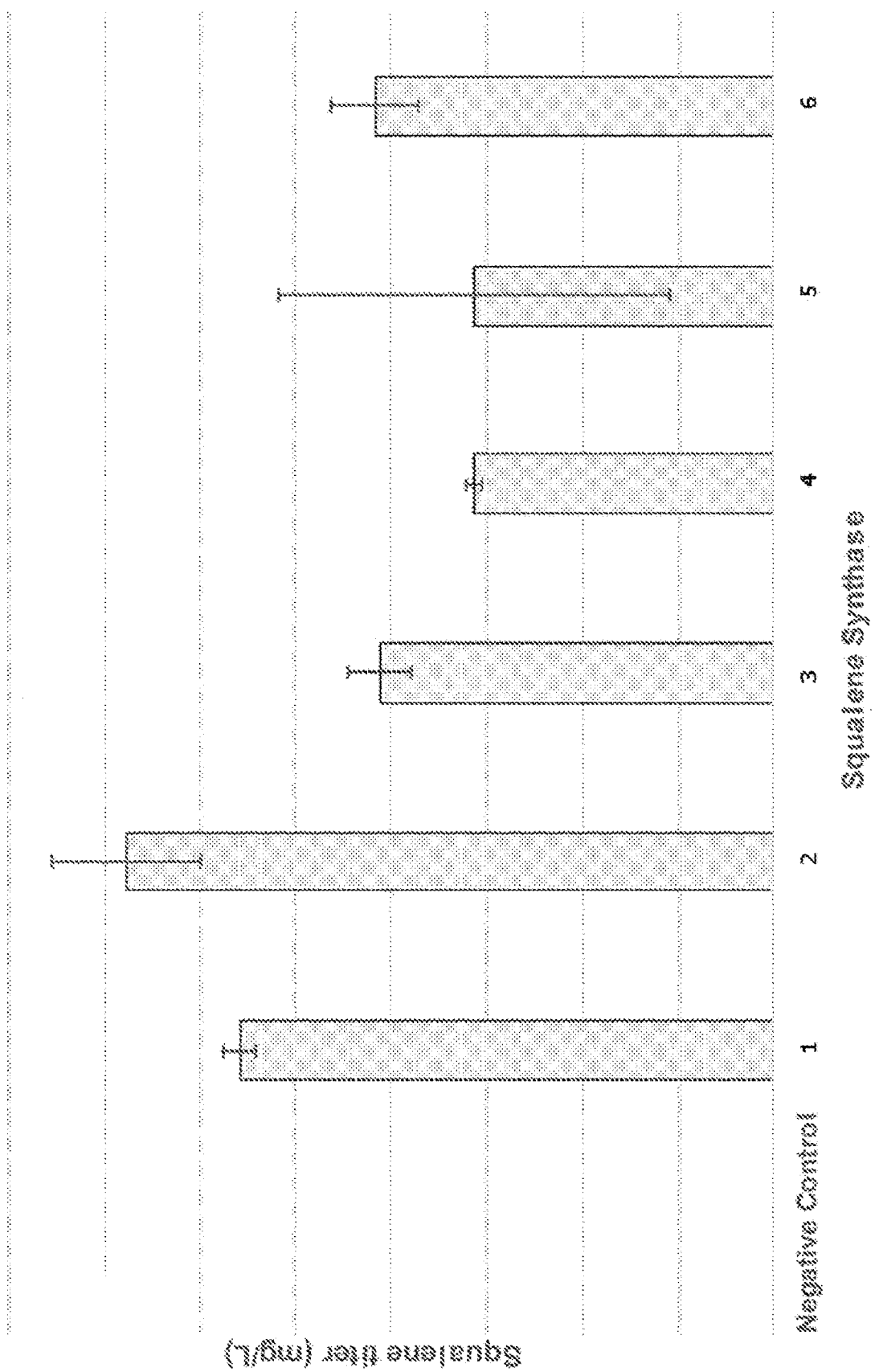
FIG. 5 shows results for in vivo production of squalene in E. coli using different squalene synthases. The asterisk denotes a different plasmid construct and experiment run on a different day from the others shown. Legend: (1) SgSQS (SEQ ID NO:2), (2) AaSQS (SEQ ID NO: 11), (3) EsSQS (SEQ ID NO: 16), (4) ElSQS (SEQ ID NO: 14), (5) FbSQS (SEQ ID NO: 166), (6) BbSQS (SEQ ID NO: 167).

In some embodiments, the SQS comprises an amino acid sequence that is at least 70% identical to SEQ ID NO: 11. For example, the SQS may comprise an amino acid sequence that is at least 80%, or at least 85%, or at least 90%, or at least 95%, or at least 98%, or at least 99% identical to SEQ ID NO: 11. In some embodiments, the SQS comprises an amino acid sequence having from 1 to 20 amino acid modifications or from 1 to 10 amino acid modifications with respect to SEQ ID NO: 11, the amino acid modifications being independently selected from amino acid substitutions, deletions, and insertions. Amino acid modifications may be made to increase expression or stability of the enzyme in the microbial cell, or to increase productivity of the enzyme. As shown in FIG. 5, AaSQS has high activity in *E. coli*.

In some embodiments, the SQS comprises an amino acid sequence that is at least 70% identical to SEQ ID NO: 2. For example, the SQS may comprise an amino acid sequence that is at least 80%, or at least 85%, or at least 90%, or at least 95%, or at least 98%, or at least 99% identical to SEQ ID NO: 2. In some embodiments, the SQS comprises an amino acid sequence having from 1 to 20 amino acid modifications or from 1 to 10 amino acid modifications with respect to SEQ ID NO: 2, the amino acid modifications being independently selected from amino acid substitutions, deletions, and insertions. Amino acid modifications may be made to increase expression or stability of the enzyme in the microbial cell, or to increase productivity of the enzyme. As shown in FIG. 5, SgSQS has high activity in *E. coli*.

In some embodiments, the SQS comprises an amino acid sequence that is at least 70% identical to SEQ ID NO: 14. For example, the SQS may comprise an amino acid sequence that is at least 80%, or at least 85%, or at least 90%, or at least 95%, or at least 98%, or at least 99% identical to SEQ ID NO: 14. In some embodiments, the SQS comprises an amino acid sequence having from 1 to 20 amino acid modifications or from 1 to 10 amino acid modifications with respect to SEQ ID NO: 14, the amino acid modifications being independently selected from amino acid substitutions, deletions, and insertions. Amino acid modifications may be made to increase expression or stability of the enzyme in the microbial cell, or to increase productivity of the enzyme. As shown in FIG. 5, EISQS was active in *E. coli*.

In some embodiments, the SQS comprises an amino acid sequence that is at least 70% identical to SEQ ID NO: 16. For example, the SQS may comprise an amino acid sequence that is at least 80%, or at least 85%, or at least 90%, or at least 95%, or at least 98%, or at least 99% identical to SEQ ID NO: 16. In some embodiments, the SQS comprises an amino acid sequence having from 1 to 20 amino acid modifications or from 1 to 10 amino acid modifications with respect to SEQ ID NO: 16, the amino acid modifications being independently selected from amino acid substitutions, deletions, and insertions. Amino acid modifications may be made to increase expression or stability of the enzyme in the microbial cell, or to increase productivity of the enzyme. As shown in FIG. 5, EsSQS was active in *E. coli*.

In some embodiments, the SQS comprises an amino acid sequence that is at least 70% identical to SEQ ID NO: 166. For example, the SQS may comprise an amino acid sequence that is at least 80%, or at least 85%, or at least 90%, or at least 95%, or at least 98%, or at least 99% identical to SEQ ID NO: 166. In some embodiments, the SQS comprises an amino acid sequence having from 1 to 20 amino acid modifications or from 1 to 10 amino acid modifications with respect to SEQ ID NO: 166, the amino acid modifications being independently selected from amino acid substitutions, deletions, and insertions. Amino acid modifications may be made to increase expression or stability of the enzyme in the microbial cell, or to increase productivity of the enzyme. As shown in FIG. 5, FbSQS was active in *E. coli*.

In some embodiments, the SQS comprises an amino acid sequence that is at least 70% identical to SEQ ID NO: 167. For example, the SQS may comprise an amino acid sequence that is at least 80%, or at least 85%, or at least 90%, or at least 95%, or at least 98%, or at least 99% identical to SEQ ID NO: 167. In some embodiments, the SQS comprises an amino acid sequence having from 1 to 20 amino acid modifications or from 1 to 10 amino acid modifications with respect to SEQ ID NO: 167, the amino acid modifications being independently selected from amino acid substitutions, deletions, and insertions. Amino acid modifications may be made to increase expression or stability of the enzyme in the microbial cell, or to increase productivity of the enzyme. As shown in FIG. 5, BbSQS was active in *E. coli*.

Amino acid modifications to the SQS enzyme can be guided by available enzyme structures and homology models, including those described in Aminfar and Tohidfar, *In silico analysis of squalene synthase in Fabaceae family using bioinformatics tools, J. Genetic Engineer. and Biotech.* 16 (2018) 739-747. The publicly available crystal structure for HsSQE (PDB entry: 6C6N) may be used to inform amino acid modifications. An alignment between AaSQS and HsSQS is shown in FIG. 27. The enzymes have 42% amino acid identity.

Figure 2:
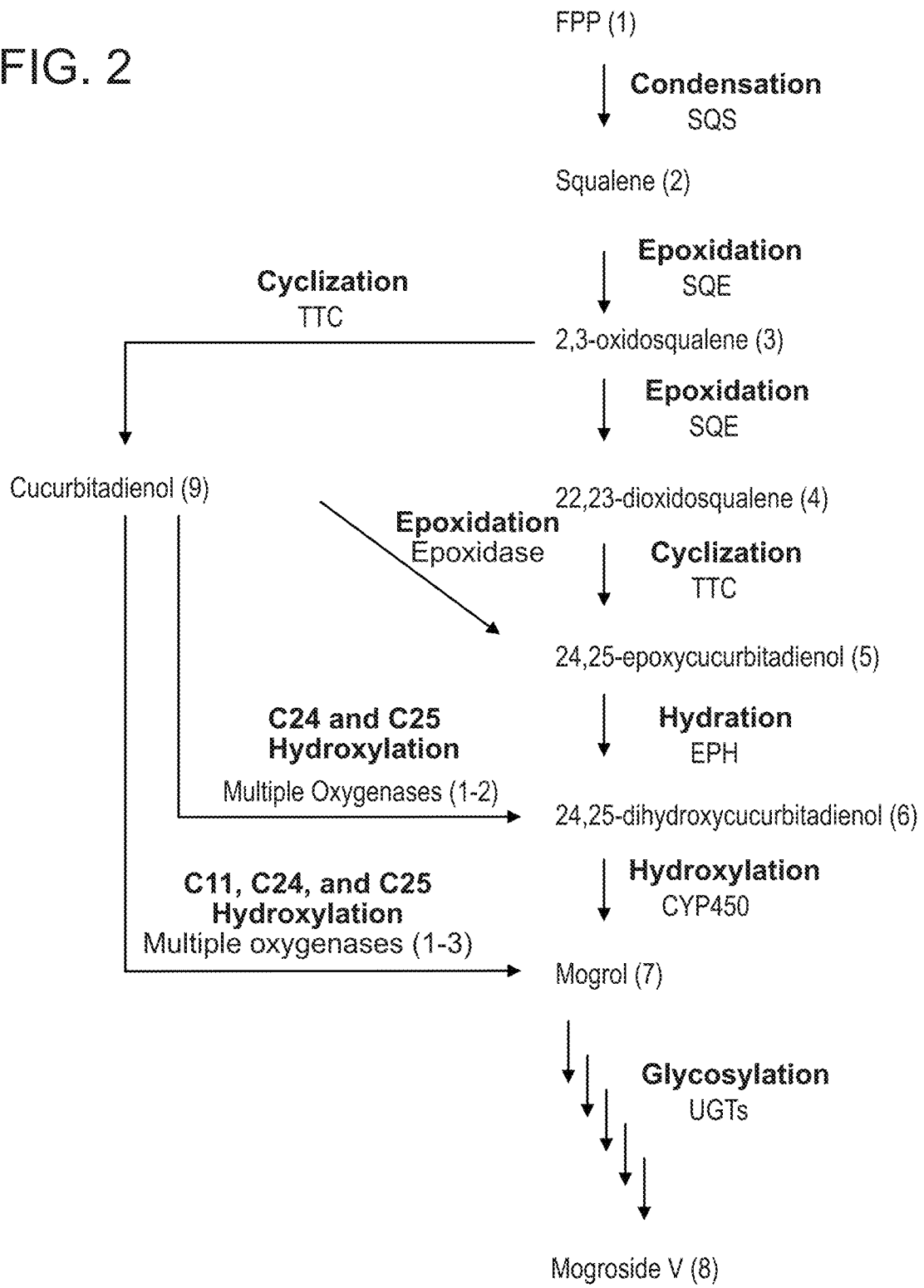
FIG. 2 shows routes to Mog.V production in vivo. The enzymatic transformation required for each step is indicated, along with the type of enzyme required. Numbers in parentheses correspond to the chemical structures in FIG. 3. Abbreviations: FPP, farnesyl pyrophosphate; SQS, squalene synthase; SQE, squalene epoxidase; TTC, triterpene cyclase; EPH, epoxide hydrolase; CYP450, cytochrome P450 with reductase partner, UGTs, uridine diphosphate glycosyltransferases.

In some embodiments, the host cell expresses one or more enzymes that produce mogrol from squalene. For example, the host cell may express one or more squalene epoxidase (SQE) enzymes, one or more triterpenoid cyclases, one or more epoxide hydrolase (EPH) enzymes, one or more cytochrome P450 oxidases (CYP450), optionally one or more non-heme iron-dependent oxygenases, and one or more cytochrome P450 reductases (CPR). As shown in FIG. 2, the heterologous pathway can proceed through several routes to mogrol, which may involve one or two epoxidations of the core substrate. In some embodiments, the pathway proceeds through cucurbitadienol, and in some embodiments, does not involve a further epoxidation step. In some embodiments, cucurbitadienol intermediate is converted to 24,25-epoxycucurbitadienol (5) by one or or more epoxidase enzymes (such as that provided herein as SEQ ID NO: 221). In still other embodiments, the pathway largely proceeds through 2,3;24,25-dioxidosqualene, with only small or minimal production of cucurbitadienol intermediate. In some embodiments, one or more of SQE, CDS, EPH, CYP450, non-heme iron-dependent oxygenases, flavodoxin reductases (FPR), ferredoxin reductases (FDXR), and CPR enzymes are engineered to increase flux to mogrol.

In some embodiments, the heterologous enzyme pathway comprises two squalene epoxidase (SQE) enzymes. For example, the heterologous enzyme pathway may comprise an SQE that produces 2,3-oxidosqualene (intermediate (3) in FIG. 2). In some embodiments, the SQE will produce 2,3;22,23-dioxidosqualene (intermediate (4) in FIG. 2), and this conversion can be catalyzed by the same SQE enzyme, or an enzyme that differs in amino acid sequence by at least one amino acid modification. For example, the squalene epoxidase enzymes may include at least two SQE enzymes each comprising (independently) an amino acid sequence that is at least 70% identical to any one of SEQ ID NOS: 17 to 39, 168 to 170, and 177 to 183. By coexpression of an SQE enzyme engineered or screened for substrate specificity for 2,3-oxidosqualene, the di-epoxy intermediate can be produced, with low or minimal levels of cucurbitadienol. In these embodiments, P450 oxygenase enzymes hydroxylating C24 and C25 of the scaffold can be eliminated.

In some embodiments, the at least one SQE comprises an amino acid sequence that is at least 70%, or at least 80%, or at least 85%, or at least 90%, or at least 95%, or at least 98%, or at least 99% identical to SEQ ID NO: 39. For example, the SQE enzyme may comprise an amino acid sequence having from 1 to 20 amino acid modifications with respect to SEQ ID NO: 39, the amino acid modifications being independently selected from amino acid substitutions, deletions, and insertions.

Figure 6:
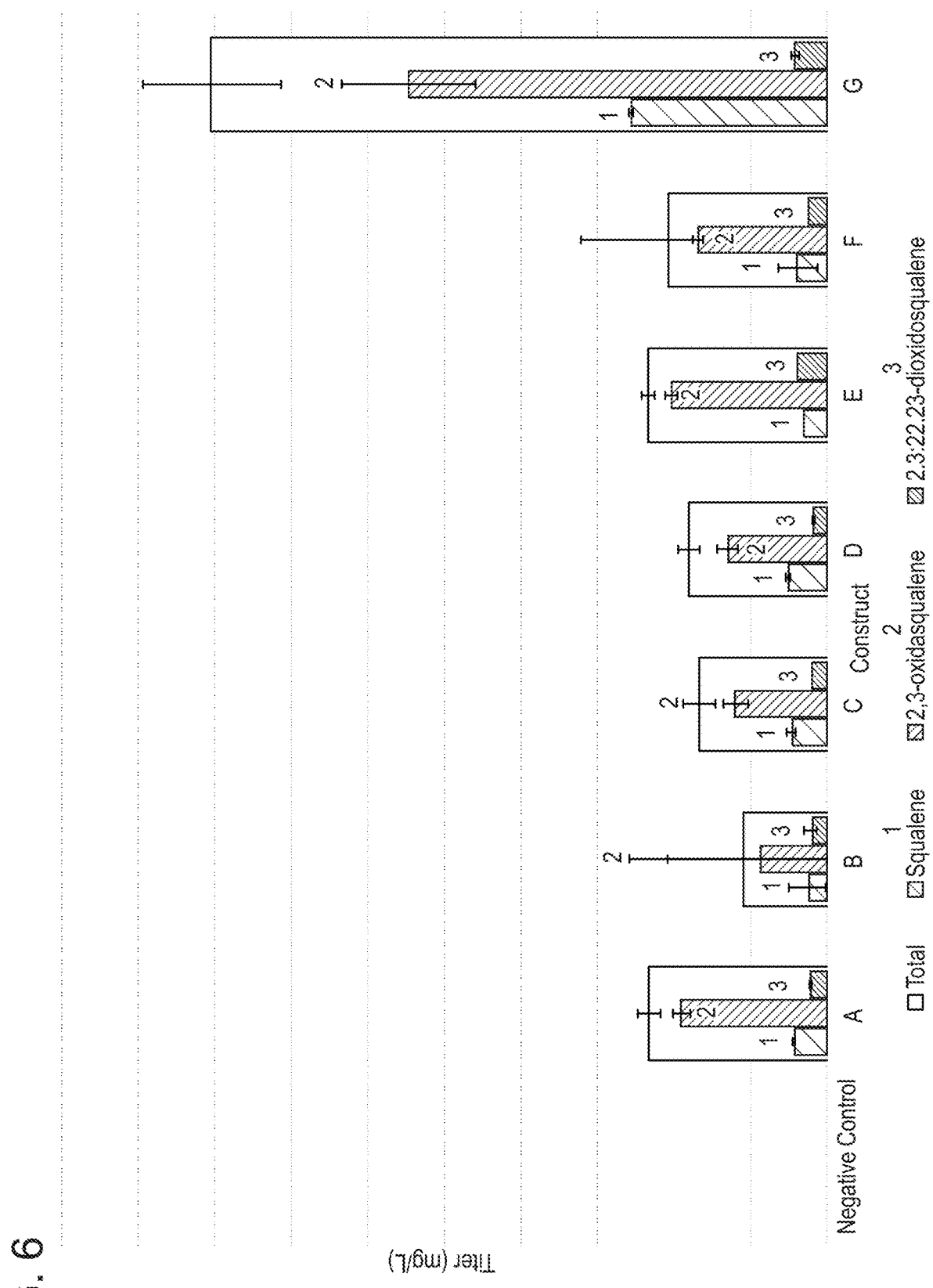
FIG. 6 shows results for in vivo production of squalene, 2,3-oxidosqualene, and 2,3;22,23-dioxidosqualene using different squalene epoxidases. Legend: (A) SEQ ID NO: 2 and SEQ ID NO: 168; (B) SEQ ID NO: 11 and SEQ ID NO: 168; (C) SEQ ID NO: 2 and SEQ ID NO 169; (D) SEQ ID NO: 11 and SEQ ID NO: 169; (E) SEQ ID NO: 2 and SEQ ID NO: 170; (F) SEQ ID NO: 2 and SEQ ID NO: 39; (G) SEQ ID NO: 11 and SEQ ID NO: 39.

As shown in FIG. 6, MlSQE has high activity in *E. coli*, particularly when coexpressed with AaSQS, where high levels of the single epoxylated product (2,3-oxidosqualene) were observed. Accordingly, coexpression of AaSQS (or an engineered derivative) with multiple copies of MlSQE engineered as described above, has good potential for bioengineering of the mogrol pathway. See FIG. 9. Amino acid modifications may be made to increase expression or stability of the SQE enzyme in the microbial cell, or to increase productivity of the enzyme.

In some embodiments, the host cell comprises two squalene epoxidase enzymes that each comprise an amino acid sequence that is at least 70% identical to *Methylomonas lenta* squalene epoxidase (SEQ ID NO: 39). For example, one of the SQE enzymes may have one or more amino acid modifications that improve specificity or productivity for conversion of 2,3-oxidosqualene to 2,3;22,23 dioxidosqualene, as compared to the enzyme having the amino acid sequence of SEQ ID NO: 39. In some embodiments, the amino acid modifications comprise one or more (or in some embodiments, 2, 3, 4, 5, 6, or 7) modifications at positions corresponding to the following positions of SEQ ID NO-39: 35, 133, 163, 254, 283, 380, and 395. For example, the amino acid at the position corresponding to position 35 of SEQ ID NO: 39 may be arginine or lysine (e.g., H35R). The position corresponding to position 133 of SEQ ID NO: 39 may be glycine, alanine, leucine, isoleucine, or valine (e.g., N133G). The amino acid at the position corresponding to position 163 of SEQ ID NO: 39 may be glycine, alanine, leucine, isoleucine, or valine (e.g., F163A). The amino acid at the position corresponding to position 254 of SEQ ID NO. 39 may be phenylalanine, alanine, leucine, isoleucine, or valine (e.g., Y254F). The amino acid at the position corresponding to position 283 of SEQ ID NO: 39 may be alanine, leucine, isoleucine, or valine (e.g., M283L). The amino acid at the position corresponding to position 380 of SEQ ID NO: 39 may be alanine, leucine, or glycine (e.g., V280L). The amino acid at the position corresponding to position 395 of SEQ ID NO 39 may be tyrosine, serine, or threonine (e.g., F395Y). Exemplary SQE enzymes in these embodiments are at least 70%, or at least 80%, or at least 90%, or at least 95% identical to SEQ ID NO: 39, but comprise the following sets of amino acid substitutions. H35R, F163A, M283L, V380L, F395Y; or H35R, N133G, F163A, Y254F, V380L, and F395Y, in each case numbered according to SEQ ID NO: 39. For example, the host cell may express an SQE comprising the amino acid sequence of SEQ. ID NO: 203 (referred to herein as MlSQE A4).

In still other embodiments, the squalene epoxidase comprises an amino acid sequence that is at least 70% identical to SEQ ID NO: 168). For example, the SQE may comprise an amino acid sequence that is at least 80%, or at least 85%, or at least 90%, or at least 95%, or at least 98%, or at least 99%/o identical to SEQ ID NO: 168. In various embodiments, the SQE comprises an amino acid sequence having from 1 to 20 amino acid modifications or from 1 to 10 amino acid modifications with respect to SEQ ID NO. 168, the amino acid modifications being independently selected from amino acid substitutions, deletions, and insertions. As shown in FIG. 6, BaESQE had good activity in *E. coli*. Amino acid modifications may be made to increase expression or stability of the enzyme in the microbial cell, or to increase productivity of the enzyme.

In some embodiments, the squalene epoxidase comprises an amino acid sequence that is at least 70% identical to SEQ ID NO: 169. For example, the SQE may comprise an amino acid sequence that is at least 80%, or at least 85%, or at least 90%, or at least 95%, or at least 98%, or at least 99% identical to SEQ ID NO: 169. In various embodiments, the SQE comprises an amino acid sequence having from 1 to 20 amino acid modifications or from 1 to 10 amino acid modifications with respect to SEQ ID NO. 169, the amino acid modifications being independently selected from amino acid substitutions, deletions, and insertions. As shown in FIG. 6, MsSQE had good activity in *E. coli*. Amino acid modifications may be made to increase expression or stability of the enzyme in the microbial cell, or to increase productivity of the enzyme.

In some embodiments, the squalene epoxidase comprises an amino acid sequence that is at least 70% identical to SEQ ID NO: 170. For example, the SQE may comprise an amino acid sequence that is at least 80%, or at least 85%, or at least 90%, or at least 95%, or at least 98%, or at least 99% identical to SEQ ID NO: 170. In various embodiments, the SQE comprises an amino acid sequence having from 1 to 20 amino acid modifications or from 1 to 10 amino acid modifications with respect to SEQ ID NO: 170, the amino acid modifications being independently selected from amino acid substitutions, deletions, and insertions. As shown in FIG. 6, MbSQE had good activity in *E. coli*. Amino acid modifications may be made to increase expression or stability of the enzyme in the microbial cell, or to increase productivity of the enzyme.

Amino acid modifications can be guided by available enzyme structures and homology models, including those described in Padyana A K, et al., *Structure and inhibition mechanism of the catalytic domain of human squalene epoxidase*, Nat. Comm. (2019) Vol. 10(97): 1-10; or Ruckenstulh et al., *Structure-Function Correlations of Two Highly Conserved Motifs in Saccharomyces cerevisiae Squalene Epoxidase*, Antimicrob. Agents and Chemo. (2008) Vol. 52(4): 1496-1499. FIG. 28 shows an alignment of HsSQE and MlSQE, which is useful for guiding engineering of the enzymes for expression, stability, and productivity in microbial host cells. The two enzymes have 35% identity.

In various embodiments, the heterologous enzyme pathway comprises a triterpene cyclase (TTC). In some embodiments, where the microbial cell coexpresses FPPS, along with the SQS, SQE, and triterpene cyclase enzymes, the microbial cell produces 2,3;22,23-dioxidosqualene. The 2,3;22,23-dioxidosqualene may be the substrate for downstream enzymes in the heterologous pathway. In some embodiments, the triterpene cyclase (TTC) comprises an amino acid sequence that is at least 70%, or at least 80%, or at least 90%, or at least 95% identical to an amino acid sequence selected from SEQ ID NOS: 40 to 55, 191 to 193, and 219 to 220. The TTC in various embodiments comprises an amino acid sequence that is at least 70% identical to the amino acid sequence of SEQ ID NO: 40. In some embodiments, the TTC comprises an amino acid sequence that is at least 80%, or at least 85%, or at least 900%, or at least 95%, or at least 98%, or at least 99%/o identical to SEQ ID NO: 40. For example, the TTC may comprise an amino acid sequence having from 1 to 20 amino acid modifications with respect to SEQ ID NO: 40, the amino acid modifications being independently selected from amino acid substitutions, deletions, and insertions.

Figure 11:
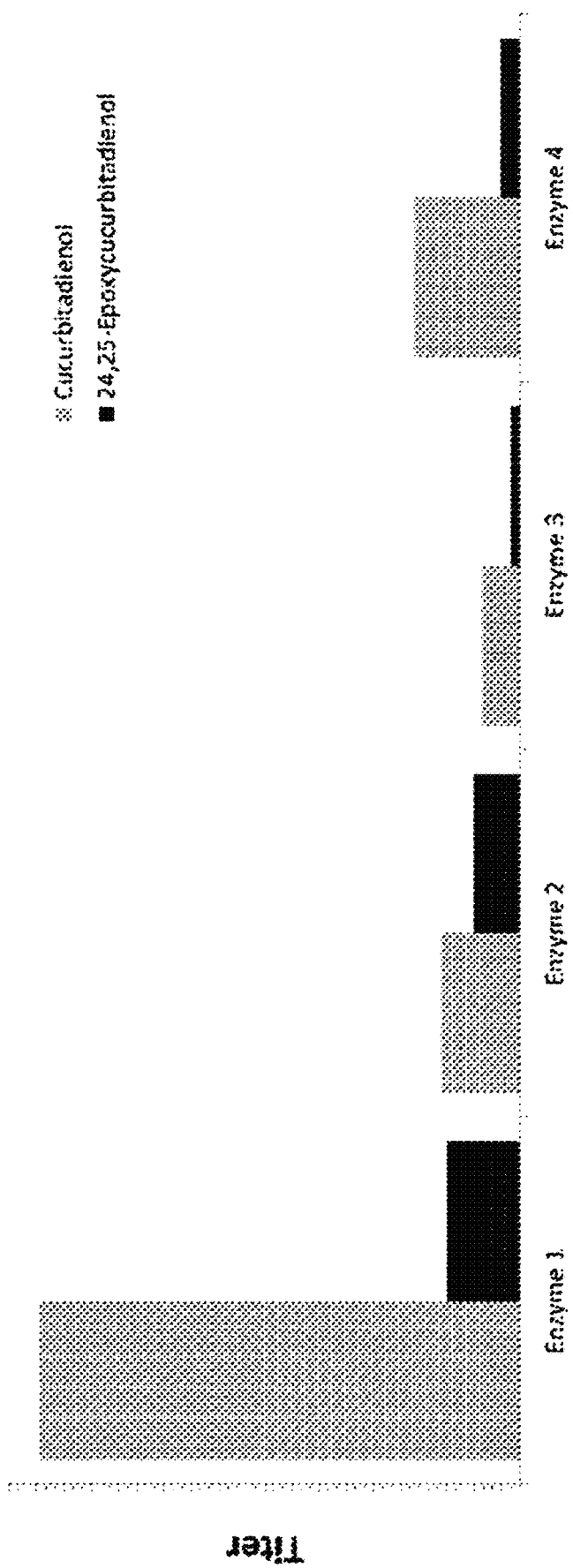
FIG. 11 shows production of cucurbitadienol and 24,25-epoxycucurbitadienol. E. coli strains producing oxidosqualene and dioxidosqualene were complemented with CDS homologs and CAS genes engineered to produce cucurbitadienol. The ratio of 24,25-epoxycucurbitadienol to cucurbitadienol varies from 0.15 for Enzyme 1 (SEQ ID NO: 40) to 0.58 for Enzyme 2 (SEQ ID NO: 192), demonstrating improved substrate specificity toward the desired 24,25-epoxycucurbitadienol product for Enzyme 2. Enzyme 3 is SEQ ID NO: 219, and Enzyme 4 is SEQ ID NO: 220.

In some embodiments, the TTC comprises an amino acid sequence that is at least 80%, or at least 85%, or at least 90%, or at least 95%, or at least 98%, or at least 99% identical to SEQ ID NO: 192. For example, the TTC may comprise an amino acid sequence having from 1 to 20 amino acid modifications with respect to SEQ ID NO: 192, the amino acid modifications being independently selected from amino acid substitutions, deletions, and insertions. The enzyme defined by SEQ ID NO: 192 shows improved specificity toward production of 24,25-epoxycucurbitadienol (FIG. 11).

In various embodiments, the heterologous enzyme pathway comprises at least two copies of a TTC enzyme gene, or comprises at least two enzymes having triterpene cyclase activity and converting 22,23-dioxidosqualene to 24,25-epoxycucurbitadienol. In such embodiments, product can be pulled to 24,25-epoxycucurbitadienol, with less production of cucurbitadienol.

Figure 10:
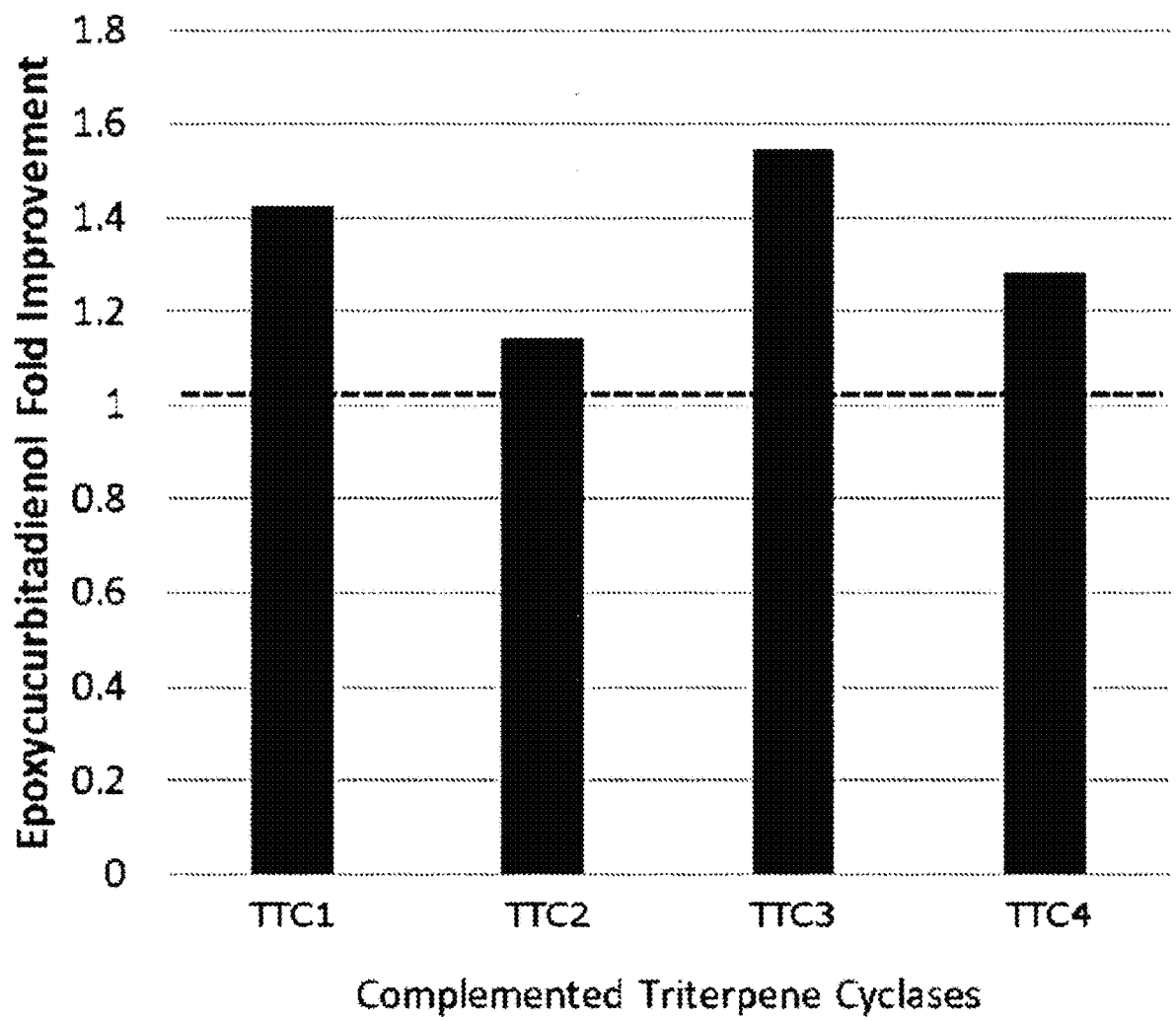
FIG. 10 shows the coexpression of SQS, SQE, and TTC enzymes. CDS of SEQ ID NO: 40, when coexpressed with SQS (SEQ ID NO: 11), SQE (SEQ ID NO: 39), and SQE A4 (SEQ ID NO: 203) in E. coli, resulted in production of cucurbitadienol and 24,25-epoxycucurbitadienol. E. coli strains coexpressing SQS (SEQ ID NO: 11), SQE (SEQ ID NO: 39), SQE A4 (SEQ ID NO: 203), and CDS (SEQ ID NO: 40), with an additional TTC produced higher levels of 24,25-epoxycucurbitadienol. Legend: TTC1 is SEQ ID NO: 92, TTC2 is SEQ ID NO: 191, TTC3 is SEQ ID NO: 193, TTC4 is SEQ ID NO: 40.

In some embodiments, the heterologous enzyme pathway comprises at least one TTC that comprises an amino acid sequence that is at least 70% identical to one of SEQ ID NO: 191, SEQ ID NO: 192, and SEQ ID NO. 193. These enzymes may be optionally co-expressed with SgCDS. These enzymes exhibit high production of 24,25-epoxycucurbitadienol. FIG. 10. Thus, in some embodiments, at least one TTC comprises an amino acid sequence that is at least 80%, or at least 85%, or at least 90%, or at least 95%, or at least 98%, or at least 99% identical to one of SEQ ID NOS: 191, 192, and 193. In some embodiments, the TTC comprises an amino acid sequence having from 1 to 20 amino acid modifications with respect to one of SEQ ID NOS: 191, 192, and 193, the amino acid modifications being independently selected from amino acid substitutions, deletions, and insertions.

Amino acid modifications may be made to increase expression or stability of the enzyme in the microbial cell, or to increase productivity of the enzyme. Amino acid modifications can be guided by available enzyme structures and homology models, including those described in Itkin M., et al., *The biosynthetic pathway of the nonsugar, high-intensity sweetener mogroside V from Siraitia grosvenorii, PNAS* (2016) Vol 113(47): E7619-E7628. For example, the CDS may be modeled using the structure of human lanosterol synthase (oxidosqualene cyclase) (PDB 1W6K).

In various embodiments, cucurbitadienol (intermediate 9 in FIG. 2) is converted to 24,25-epoxycucurbitadienol (5) by one of more enzymes expressed in the host cell. For example, the heterologous pathway may comprise an enzyme having at least about 70%, or at least about 80%, or at least about 85%, or at least about 90%, or at least about 95%, or at least about 97%, 98%, or 99% sequence identity with SEQ ID NO: 221.

In some embodiments, the heterologous enzyme pathway comprises at least one epoxide hydrolase (EPH). The EPH may comprise an amino acid sequence that is at least 70% identical to amino acid sequence selected from SEQ ID NOS: 56 to 72, 184 to 190, and 212. In some embodiments, the EPH may employ as a substrate 24,25-epoxycucurbitadienol (intermediate (5) of FIG. 2), for production of 24,25-dihydroxycucurbitadienol (intermediate (6) of FIG. 2). In some embodiments, the EPH comprises an amino acid sequence that is at least 80%, or at least 85%, or at least 90%, or at least 95%, or at least 98%, or at least 99% identical to one of SEQ ID NOS: 56 to 72, 184 to 190, and 212. Thus, in some embodiments, the EPH comprises an amino acid sequence having from 1 to 20 amino acid modifications with respect to one of SEQ ID NOS: 56 to 72, 184 to 190, and 212, the amino acid modifications being independently selected from amino acid substitutions, deletions, and insertions.

In some embodiments, the heterologous pathway comprises at least one EPH enzyme converting 24,25-epoxycucurbitadienol to 24,25-dihydroxycucurbitadienol, the at least one EPH enzyme comprising an amino acid sequence that is at least 70% identical to one of: SEQ ID NO: 189, SEQ ID NO: 58, SEQ ID NO: 184, SEQ ID NO: 185, SEQ ID NO: 187, SEQ ID NO: 188, SEQ ID NO: 190, and SEQ ID NO: 212. See FIG. 12. In some embodiments, the EPH enzyme comprises an amino acid sequence that is at least 80%, or at least 85%, or at least 90%, or at least 95%, or at least 98%, or at least 99% identical to one of SEQ ID NOS: 189, 58, 184, 185, 187, 188, 190, and 212. For example, the EPH may comprise an amino acid sequence having from 1 to 20 amino acid modifications with respect to one of SEQ ID NOS: 189, 58, 184, 185, 187, 188, 190, and 212, the amino acid modifications being independently selected from amino acid substitutions, deletions, and insertions. Amino acid modifications may be made to increase expression or stability of the enzyme in the microbial cell, or to increase productivity of the enzyme.

In some embodiments, the heterologous pathway comprises one or more oxidases. The one or more oxidases may be active on cucurbitadienol or oxygenated products thereof as a substrate, adding (collectively) hydroxylations at C11, C24 and 25, thereby producing mogrol (see FIG. 2). Alternatively, the heterologous pathway may comprise one or more oxidases that oxidize C11 of C24,25 dihydroxycucurbitadienol to produce mogrol.

In some embodiments, at least one oxidase is a cytochrome P450 enzyme. Exemplary cytochrome P450 enzymes comprise an amino acid sequence that is at least 70% identical to an amino acid sequence selected from SEQ ID NOS: 73 to 91, 171 to 176, and 194 to 200. In some embodiments, at least one P450 enzyme comprises an amino acid sequence that is at least 80%, or at least 85%, or at least 90%, or at least 95%, or at least 98%, or at least 99% identical to one of SEQ ID NOS: 73 to 91, 171 to 176, and 194 to 200. For example, at least one cytochrome P450 enzyme comprises an amino acid sequence having from 1 to 20 amino acid modifications with respect to one of SEQ ID NOS: 73 to 91, 171 to 176, and 194 to 200, the amino acid modifications being independently selected from amino acid substitutions, deletions, and insertions.

In some embodiments, the microbial host cell expresses a heterologous enzyme pathway comprising a P450 enzyme having activity for oxidation at C11 of C24,25 dihydroxycucurbitadienol, to thereby produce mogrol. For example, in some embodiments, the cytochrome P450 comprises an amino acid sequence that is at least 70% identical to an amino acid sequence selected from SEQ ID NO: 194 and SEQ ID NO: 171. See FIGS. 13A-C, FIG. 14, and FIG. 15. In some embodiments, the microbial host cell expresses a cytochrome P450 enzyme that comprises an amino acid sequence that is at least 80%, or at least 85%, or at least 90%, or at least 95%, or at least 98%, or at least 99% identical to one of SEQ ID NOS: 194 and 171. In some embodiments, at least one cytochrome P450 enzyme comprises an amino acid sequence having from 1 to 20 amino acid modifications with respect to one of SEQ ID NOS: 194 and 171, the amino acid modifications being independently selected from amino acid substitutions, deletions, and insertions.

In some embodiments, the cytochrome P450 enzyme has at least a portion of its transmembrane region substituted with a heterologous transmembrane region. For example, particularly in embodiments in which the microbial cell is a bacterium, the CYP450 and/or CPR is modified as described in US 2018/0251738, the contents of which are hereby incorporated by reference in their entireties. For example, in some embodiments, the CYP450 enzyme has a deletion of all or part of the wild type P450 N-terminal transmembrane region, and the addition of a transmembrane domain derived from an E. coli or bacterial inner membrane, cytoplasmic C-terminus protein. In some embodiments, the transmembrane domain is a single-pass transmembrane domain. In some embodiments, the transmembrane domain is a multipass (e.g., 2, 3, or more transmembrane helices)transmembrane domain. Exemplary transmembrane domains are derived from E. coli zipA or sohB. Alternatively, the P450 enzyme can employ its native transmembrane anchor, or the well-known bovine 17a anchor. See FIG. 14.

In some embodiments, the microbial host cell expresses a non-heme iron oxidase. Exemplary non-heme iron oxidases comprise an amino acid sequence that is at least 70% identical to an amino acid sequence selected from SEQ ID NOS: 100 to 115. In some embodiments, the non-heme iron oxidase comprises an amino acid sequence that is at least 80%, or at least 85%, or at least 90%, or at least 95%, or at least 98%, or at least 99% identical to one of SEQ ID NOS: 100 to 115.

In various embodiments, the microbial host cell expresses one or more electron transfer proteins selected from a cytochrome P450 reductase (CPR), flavodoxin reductase (FPR) and ferredoxin reductase (FDXR) sufficient to regenerate the one or more oxidases. Exemplary CPR proteins are provided herein as SEQ ID NOS: 92 to 99 and 201.

In some embodiments, the microbial host cell expresses a cytochrome P450 reductase, and which may comprise an amino acid sequence that is at least 70%, or at least 80%, or at least 85%, or at least 90%, or at least 95%, or at least 98%, or at least 99% identical to one of SEQ ID NOS: 92 to 99 and 201. For example, in some embodiments, the microbial host cell expresses SEQ ID NO: 194 or a derivative thereof (as described above), and SEQ ID NO: 98 or a derivative thereof (i.e., having at least 70%, at least 80%, or at least 90% sequence identity thereto). In some embodiments, the microbial host cell expresses SEQ ID NO: 171 or a derivative thereof (as described above), and SEQ ID NO: 201 or a derivative thereof (i.e., having at least 70%, at least 80%, or at least 90% sequence identity thereto).

In various embodiments, the heterologous enzyme pathway produces mogrol, which may be an intermediate for downstream enzymes in the heterologous pathway, or in some embodiments is recovered from the culture. Mogrol may be recovered from host cells in some embodiments, and/or can be recovered from the culture media.

In some embodiments, the heterologous enzyme pathway further comprises one or more uridine diphosphate-dependent glycosyltransferase (UGT) enzymes, thereby producing one or more mogrol glycosides (or "mogrosides"). The mogrol glycoside may be pentaglycosylated, hexaglycosylated, or more (e.g., 7, 8, or 9 glycosylations), in some embodiments. In other embodiments, the mogrol glycoside has two, three, or four glucosylations. The one or more mogrol glycosides may be selected from Mog.II-E, Mog.III, Mog.III-A1, Mog.III-A2, Mog.III, Mog.IV, Mog.IV-A, siamenoside, isomog.V, Mog.V, or Mog.VI. In some embodiments, the host cell produces Mog.V or siamenoside.

In some embodiments, the host cell expresses a UGT enzyme that catalyzes the primary glycosylation of mogrol at C24 and/or C3 hydroxyl groups. In some embodiments, the UGT enzyme catalyzes a branching glycosylation, such as a beta 1,2 and/or beta 1,6 branching glycosylation at the primary C3 and C24 glucosyl groups. UGT enzymes observed to catalyze primary glycosylation of C24 and/or C3 hydroxyl groups are summarized in Table 1. UGT enzymes observed to catalyze various branching glycosylation reactions are summarized in Table 2.

In some embodiments, at least one UGT enzyme comprises an amino acid sequence that is at least 70% identical to an amino acid sequence selected from SEQ ID NOS: 116 to 165, 202 to 210, 211, and 213 to 218. For example, in some embodiments, the UGT enzyme comprises an amino acid sequence that is at least 80%, or at least 85%, or at least 90%, or at least 95%, or at least 98%, or at least 99% identical to one of SEQ ID NOS: 116 to 165, 202 to 210, 211, and 213 to 218 Thus, at least one UGT enzyme comprises an amino acid sequence having from 1 to 20 amino acid modifications with respect to one of SEQ ID NOS: 116 to 165, 202 to 210, 211, and 212 to 218, the amino acid modifications being independently selected from amino acid substitutions, deletions, and insertions.

For example, in some embodiments, the microbial cell expresses at least four UGT enzymes, resulting in glucosylation of mogrol at the C3 hydroxyl group, the C24 hydroxyl group, as well as a further 1,6 glucosylation at the C3 glucosyl group, and a further 1,6 glucosylation and a further 1,2 glucosylation at the C24 glucosyl group. The product of such glucosylation reactions is Mog.V.

In some embodiments, at least one UGT enzyme comprises an amino acid sequence having at least 70% sequence identity to one of SEQ ID NO: 164, 165, 138, 204 to 211, and 213 to 218.

In some embodiments, at least one UGT enzyme comprises an amino acid sequence that is at least 70% identical to UGT85C1 (SEQ ID NO: 165). UGT85C1 exhibits primary glycosylation at the C3 and C24 hydroxyl groups. Thus, in some embodiments, at least one UGT enzyme comprises an amino acid sequence that is at least 80%, or at least 85%, or at least 90%, or at least 95%, or at least 98%, or at least 99% identical to SEQ ID NO. 165. The at least one UGT enzyme may comprise an amino acid sequence having from 1 to 20 amino acid modifications with respect to SEQ ID NO: 165, the amino acid modifications being independently selected from amino acid substitutions, deletions, and insertions. Exemplary amino acid substitutions include substitutions at positions 41 (e.g., L41F or L41Y), 49 (e.g., D49E), and 127 (e.g., C127F or C127Y).

In some embodiments, at least one UGT enzyme comprises an amino acid sequence that is at least 70% identical to SEQ ID NO: 164, which exhibits activity for adding branching glycosylations, both 1-2 and 1-6 branching glycosylations. In various embodiments, at least one UGT enzyme comprises an amino acid sequence that is at least 80%, or at least 85%, or at least 90%, or at least 95%, or at least 98%, or at least 99% identical to SEQ ID NO: 164. In exemplary embodiments, at least one UGT enzyme comprises an amino acid sequence having from 1 to 20 amino acid modifications with respect to SEQ ID NO: 164, the amino acid modifications being independently selected from amino acid substitutions, deletions, and insertions. Exemplary amino acid substitutions are shown in Table 3. Exemplary amino acid substitutions include substitutions at one or more positions selected from 150 (e.g., S150F, S150Y), 147 (e.g., T147L, T147V, T147I, and T147A), 207 (e.g., N207K or N207R), 270 (e.g., K270E or K270D), 281 (V281L or V281I), 354 (e.g., L354V or L354I), 13 (e.g., L13F or L13Y), 32 (T32A or T32G or T32L), and 101 (K101A or K101G), with respect to SEQ ID NO: 164. An exemplary engineered UGT enzyme comprises the amino acid substitutions T147L and N207K, with respect to SEQ ID NO: 164.

In some embodiments, at least one UGT enzyme comprises an amino acid sequence that is at least 70% identical to SEQ ID NO: 138, which exhibits an activity to catalyze 1-6 branching glycosylations. In some embodiments, at least one UGT enzyme comprises an amino acid sequence that is at least 80%, or at least 85%, or at least 90%, or at least 95%, or at least 98%, or at least 99% identical to SEQ ID NO: 138. In exemplary embodiments, at least one UGT enzyme comprises an amino acid sequence having from 1 to 20 amino acid modifications with respect to SEQ ID NO: 138, the amino acid modifications being independently selected from amino acid substitutions, deletions, and insertions.

In some embodiments, at least one UGT enzyme comprises an amino acid sequence that is at least 70% identical to SEQ ID NO: 204, which catalyzes 1-6 branching glycosylation, particularly at the C3 primary glucosylation. For example, at least one UGT enzyme may comprise an amino acid sequence that is at least 80%, or at least 85%, or at least 90%, or at least 95%, or at least 98%, or at least 99% identical to SEQ ID NO: 204. In exemplary embodiments, at least one UGT enzyme comprises an amino acid sequence having from 1 to 20 amino acid modifications with respect to SEQ ID NO: 204, the amino acid modifications being independently selected from amino acid substitutions, deletions, and insertions.

In some embodiments, at least one UGT enzyme comprises an amino acid sequence that is at least 70% identical to SEQ ID NO: 205, which catalyzes 1-6 branching glycosylation, including at both the C3 and C24 primary glucosylations. For example, at least one UGT enzyme may comprise an amino acid sequence that is at least 80%, or at least 85%, or at least 90%, or at least 95%, or at least 98%, or at least 99% identical to SEQ ID NO: 205. In exemplary embodiments, at least one UGT enzyme comprises an amino acid sequence having from 1 to 20 amino acid modifications with respect to SEQ ID NO: 205, the amino acid modifications being independently selected from amino acid substitutions, deletions, and insertions.

In some embodiments, at least one UGT enzyme comprises an amino acid sequence that is at least 70% identical to SEQ ID NO: 206, which catalyzes 1-2 and 1-6 branching glycosylations. For example, at least one UGT enzyme may comprise an amino acid sequence that is at least 80%, or at least 85%, or at least 90%, or at least 95%, or at least 98%, or at least 99% identical to SEQ ID NO: 206. In exemplary embodiments, at least one UGT enzyme comprises an amino acid sequence having from 1 to 20 amino acid modifications with respect to SEQ ID NO: 206, the amino acid modifications being independently selected from amino acid substitutions, deletions, and insertions.

In some embodiments, at least one UGT enzyme comprises an amino acid sequence that is at least 70% identical to SEQ ID NO: 207, which catalyzes 1-6 branching glycosylations of the primary glucosylations. For example, at least one UGT enzyme may comprise an amino acid sequence that is at least 80%, or at least 85%, or at least 90%, or at least 95%, or at least 98%, or at least 99% identical to SEQ ID NO: 207. In exemplary embodiments, at least one UGT enzyme comprises an amino acid sequence having from 1 to 20 amino acid modifications with respect to SEQ ID NO: 207, the amino acid modifications being independently selected from amino acid substitutions, deletions, and insertions.

In some embodiments, at least one UGT enzyme comprises an amino acid sequence that is at least 70% identical to SEQ ID NO: 208, which catalyzes 1-2 and 1-6 branching glycosylations. For example, at least one UGT enzyme may comprise an amino acid sequence that is at least 80%, or at least 85%, or at least 90%, or at least 95%, or at least 98%, or at least 99% identical to SEQ ID NO: 208. In exemplary embodiments, at least one UGT enzyme comprises an amino acid sequence having from 1 to 20 amino acid modifications with respect to SEQ ID NO: 208, the amino acid modifications being independently selected from amino acid substitutions, deletions, and insertions.

In some embodiments, at least one UGT enzyme comprises an amino acid sequence that is at least 70% identical to SEQ ID NO: 209, which catalyzes 1-6 branching glycosylations of the primary glucosylations. For example, at least one UGT enzyme may comprise an amino acid sequence that is at least 80%, or at least 85%, or at least 90%, or at least 95%, or at least 98%, or at least 99% identical to SEQ ID NO: 209. In exemplary embodiments, at least one UGT enzyme comprises an amino acid sequence having from 1 to 20 amino acid modifications with respect to SEQ ID NO: 209, the amino acid modifications being independently selected from amino acid substitutions, deletions, and insertions.

In some embodiments, at least one UGT enzyme comprises an amino acid sequence that is at least 70% identical to SEQ ID NO: 210), which catalyzes 1-6 branching glycosylations of the primary glucosylations. For example, at least one UGT enzyme may comprise an amino acid sequence that is at least 80%, or at least 85%, or at least 90%, or at least 95%, or at least 98%, or at least 99% identical to SEQ ID NO: 210. In exemplary embodiments, at least one UGT enzyme comprises an amino acid sequence having from 1 to 20 amino acid modifications with respect to SEQ ID NO: 210, the amino acid modifications being independently selected from amino acid substitutions, deletions, and insertions.

In some embodiments, at least one UGT enzyme comprises an amino acid sequence that is at least 70%/identical to SEQ ID NO: 211, which catalyzes 1-2 branching glycosylation of the C24 primary glucosylation. For example, at least one UGT enzyme may comprise an amino acid sequence that is at least 80%, or at least 85%, or at least 90%, or at least 95%, or at least 98%, or at least 99% identical to SEQ ID NO: 211. In exemplary embodiments, at least one UGT enzyme comprises an amino acid sequence having from 1 to 20 amino acid modifications with respect to SEQ ID NO: 210, the amino acid modifications being independently selected from amino acid substitutions, deletions, and insertions.

In some embodiments, at least one UGT enzyme comprises an amino acid sequence that is at least 70% identical to SEQ ID NO: 213, which catalyzes 1-6 branching glycosylation of the primary glucosylation at C24. For example, at least one UGT enzyme may comprise an amino acid sequence that is at least 80%, or at least 85%, or at least 90%, or at least 95%, or at least 98%, or at least 99% identical to SEQ ID NO: 213. In exemplary embodiments, at least one UGT enzyme comprises an amino acid sequence having from 1 to 20 amino acid modifications with respect to SEQ ID NO: 213, the amino acid modifications being independently selected from amino acid substitutions, deletions, and insertions.

In some embodiments, at least one UGT enzyme comprises an amino acid sequence that is at least 70% identical to SEQ ID NO: 214, which catalyzes primary glucosylation at C24. For example, at least one UGT enzyme may comprise an amino acid sequence that is at least 80%, or at least 85%, or at least 90%, or at least 95%, or at least 98%, or at least 99% identical to SEQ ID NO: 214. In exemplary embodiments, at least one UGT enzyme comprises an amino acid sequence having from 1 to 20 amino acid modifications with respect to SEQ ID NO: 214, the amino acid modifications being independently selected from amino acid substitutions, deletions, and insertions.

In some embodiments, at least one UGT enzyme comprises an amino acid sequence that is at least 70% identical to SEQ ID NO: 215, which catalyzes 1-6 branching glucosylation at C24. For example, at least one UGT enzyme may comprise an amino acid sequence that is at least 80%, or at least 85%, or at least 90%, or at least 95%, or at least 98%, or at least 99% identical to SEQ ID NO: 215. In exemplary embodiments, at least one UGT enzyme comprises an amino acid sequence having from 1 to 20 amino acid modifications with respect to SEQ ID NO: 215, the amino acid modifications being independently selected from amino acid substitutions, deletions, and insertions.

In still other embodiments, at least one UGT enzyme comprises an amino acid sequence that is at least 70% identical to SEQ ID NO: 146, which provides for glucosylation of the C24 hydroxyl of mogrol or Mog.IE. In some embodiments, at least one UGT enzyme comprises an amino acid sequence that is at least 80%, or at least 85%, or at least 90%, or at least 95%, or at least 98%, or at least 99% identical to SEQ ID NO. 146. In some embodiments, at least one UGT enzyme comprises an amino acid sequence having from 1 to 20 or from 1 to 10 amino acid modifications with respect to SEQ ID NO: 146, the amino acid modifications being independently selected from amino acid substitutions, deletions, and insertions. Amino acid modifications may be made to increase expression or stability of the enzyme in the microbial cell, or to increase productivity of the enzyme for particular substrates.

In some embodiments, at least one UGT enzyme comprises an amino acid sequence that is at least 70% identical to SEQ ID NO: 202, which catalyzes primary glycosylation at the C3 and C24 hydroxyl. For example, at least one UGT enzyme may comprise an amino acid sequence that is at least 80%, or at least 85%, or at least 90%, or at least 95%, or at least 98%, or at least 99% identical to SEQ ID NO: 202. In exemplary embodiments, at least one UGT enzyme comprises an amino acid sequence having from 1 to 20 amino acid modifications with respect to SEQ ID NO: 202, the amino acid modifications being independently selected from amino acid substitutions, deletions, and insertions.

In some embodiments, at least one UGT enzyme comprises an amino acid sequence that is at least 70% identical to SEQ ID NO: 218, which catalyzes primary glycosylation at the C24 hydroxyl. For example, at least one UGT enzyme may comprise an amino acid sequence that is at least 80%, or at least 85%, or at least 90%, or at least 95%, or at least 98%, or at least 99% identical to SEQ ID NO: 218. In exemplary embodiments, at least one UGT enzyme comprises an amino acid sequence having from 1 to 20 amino acid modifications with respect to SEQ ID NO: 218, the amino acid modifications being independently selected from amino acid substitutions, deletions, and insertions.

In some embodiments, at least one UGT enzyme comprises an amino acid sequence that is at least 70% identical to SEQ ID NO: 217, which catalyzes primary glycosylation at the C24 hydroxyl. For example, at least one UGT enzyme may comprise an amino acid sequence that is at least 80%, or at least 85%, or at least 90%, or at least 95%, or at least 98%, or at least 99% identical to SEQ ID NO: 217. In exemplary embodiments, at least one UGT enzyme comprises an amino acid sequence having from 1 to 20 amino acid modifications with respect to SEQ ID NO: 217, the amino acid modifications being independently selected from amino acid substitutions, deletions, and insertions. Exemplary amino acid substitutions include substitutions at one or more positions (with respect to SEQ ID NO: 17) selected from 74 (e.g., A74E or A74D), 91 (I91F or I91Y), 101 (e.g., H101P), 241 (e.g., Q241E or Q241D), and 436 (e.g., I436L or I436A). In some embodiments, the UGT enzyme comprises the following amino acid substitutions with respect to SEQ ID NO: 217: A74E, 191F, and H101P.

In some embodiments, at least one UGT enzyme comprises an amino acid sequence that is at least 70% identical to SEQ ID NO: 216, which catalyzes primary glycosylation at the C24 hydroxyl. For example, at least one UGT enzyme may comprise an amino acid sequence that is at least 80%, or at least 85%, or at least 90%, or at least 95%, or at least 98%, or at least 99% identical to SEQ ID NO: 216. In exemplary embodiments, at least one UGT enzyme comprises an amino acid sequence having from 1 to 20 amino acid modifications with respect to SEQ ID NO: 216, the amino acid modifications being independently selected from amino acid substitutions, deletions, and insertions.

In some embodiments, at least one UGT enzyme comprises an amino acid sequence that is at least 70% identical to SEQ ID NO: 117, SEQ ID NO: 210, or SEQ ID NO: 122. For example, the enzyme defined by SEQ ID NO: 117 catalyzes branching glycosylations. In some embodiments, at least one UGT enzyme comprises an amino acid sequence that is at least 80%, or at least 85%, or at least 90%, or at least 95%, or at least 98%, or at least 99% identical to SEQ ID NO: 117, SEQ ID NO: 210, or SEQ ID NO: 122. In some embodiments, at least one UGT enzyme comprises an amino acid sequence having from 1 to 20 amino acid modifications with respect to SEQ ID NO: 117, 210, or 122, the amino acid modifications being independently selected from amino acid substitutions, deletions, and insertions.

In some embodiments, the microbial cell expresses at least one UGT enzyme capable of catalyzing beta 1,2 addition of a glucose molecule to at least the C24 glucosyl group (e.g., of Mog.IVA). Exemplary UGT enzymes in accordance with these embodiments include SEQ ID NO: 117, SEQ ID NO:147, SEQ ID NO: 148, SEQ ID NO: 149, SEQ ID NO: 150, or SEQ ID NO: 163, or derivatives thereof. Derivatives include enzymes comprising amino acid sequence that are least 70% identical to one or more of SEQ ID NO: 117, SEQ ID NO: 147, SEQ ID NO: 148, SEQ ID NO: 149, SEQ ID NO: 150, and SEQ ID NO: 163. In some embodiments, the UGT enzyme catalyzing beta 1,2 addition of a glucose molecule to at least the C24 glucosyl group comprises an amino acid sequence that is at least 80%, or at least 85%, or at least 90%, or at least 95%, or at least 98%, or at least 99% identical to one or more of SEQ ID NO: 117, SEQ ID NO: 147, SEQ ID NO: 148, SEQ ID NO: 149, SEQ ID NO. 150, and SEQ ID NO: 163. In some embodiments, at least one UGT enzyme comprises an amino acid sequence having from 1 to 20 or having from 1 to 10 amino acid modifications with respect to SEQ ID NO. 117, SEQ ID NO: 147, SEQ ID NO: 148, SEQ ID NO: 149, SEQ ID NO: 150, and SEQ ID NO: 163, the amino acid modifications being independently selected from amino acid substitutions, deletions, and insertions. Amino acid modifications may be made to increase expression or stability of the enzyme in the microbial cell, or to increase productivity of the enzyme for particular substrates.

In some embodiments, at least one UGT enzyme is a circular permutant of a wild-type UGT enzyme, optionally having amino acid substitutions, deletions, and/or insertions with respect to the corresponding position of the wild-type enzyme. Circular permutants can provide novel and desirable substrate specificities, product profiles, and reaction kinetics over the wild-type enzymes. A circular permutant retains the same basic fold of the parent enzyme, but has a different position of the N-terminus (e.g., "cut-site"), with the original N- and C-termini connected, optionally by a linking sequence. For example, in the circular permutants, the N-terminal Methionine is positioned at a site in the protein other than the natural N-terminus. UGT circular permutants are described in US 2017/0332673, which is hereby incorporated by reference in its entirety. In some embodiments, at least one UGT enzyme is a circular permutant of a UGT enzyme described herein, such as but not limited to SEQ ID NO: 146, SEQ ID NO: 164, or SEQ ID NO: 165, SEQ ID NO: 117, SEQ ID NO: 147, SEQ ID NO: 148, SEQ ID NO: 149, SEQ ID NO: 150, SEQ ID NO: 163, SEQ ID NO: 202, SEQ ID NO: 216, SEQ ID NO: 217, and SEQ ID NO: 218. In some embodiments, the circular permutant further has one or more amino acid modifications (e.g., amino acid substitutions, deletions, and/or insertions) with respect to the parent UGT enzyme. In these embodiments, the circular permutant will have at least about 70%, or at least about 80%, or at least about 90%, or at least about 95%, or at least about 98% identity to the parent enzyme, when the corresponding amino acid sequences are aligned (i.e., without regard to the new N-terminus of the circular permutant). An exemplary circular permutant for use according to some embodiments is SEQ ID NO: 206.

In some embodiments, the microbial host cell expresses at least three UGT enzymes: a first UGT enzyme catalyzing primary glycosylation at the C24 hydroxyl of mogrol, a second UGT enzyme catalyzing primary glycosylation at the C3 hydroxyl of mogrol, and a third UGT enzyme catalyzing one or more branching glycosylation reactions. In some embodiments, the microbial host cell expresses one or two UGT enzymes catalyzing beta 1,2 and/or beta 1,6 branching glycosylations of the C3 and/or C24 primary glycosylations. For example, the UGT enzymes may comprise three or four UGT enzymes selected from:

SEQ ID NO: 165 or a derivative thereof;
SEQ ID NO: 146 or a derivative thereof;
SEQ ID NO: 214 or a derivative thereof;
SEQ ID NO: 129 or a derivative thereof;
SEQ ID NO: 164 or a derivative thereof;
SEQ ID NO: 116 or a derivative thereof;
SEQ ID NO: 202 or a derivative thereof;
SEQ ID NO: 218 or a derivative thereof;
SEQ ID NO: 217 or a derivative thereof;
SEQ ID NO: 138 or a derivative thereof;
SEQ ID NO: 204 or a derivative thereof;
SEQ ID NO: 205 or a derivative thereof;
SEQ ID NO: 207 or a derivative thereof;
SEQ ID NO: 208 or a derivative thereof;
SEQ ID NO: 209 or a derivative thereof;
SEQ ID NO: 11 or a derivative thereof;
SEQ ID NO: 215 or a derivative thereof;
SEQ ID NO: 213 or a derivative thereof;
SEQ ID NO: 206 or a derivative thereof;
SEQ ID NO: 122 or a derivative thereof; and
SEQ ID NO: 210) or a derivative thereof. Derivatives have sequence identity to the reference enzyme as described herein.

In some embodiments, the microbial host cell has one or more genetic modifications that increase the production of UDP-glucose, the co-factor employed by UGT enzymes. These genetic modifications may include one or more, or two or more (or all) of ΔgalE, ΔgalT, ΔgalK, ΔgalM, ΔushA, Δagp, Δpgm, duplication of *E. coli* galU, expression of *Bacillus subtilis* UGPA, and expression of *Bifidobacterium adolescentis* SPL.

Mogrol glycosides can be recovered from the microbial culture. For example, mogrol glycosides may be recovered from microbial cells, or in some embodiments, are predominately available in the extracellular media, where they may be recovered or sequestered.

In various embodiments, the reaction is performed in a microbial cell, and UGT enzymes are recombinantly expressed in the cell. In some embodiments, mogrol is produced in the cell by a heterologous mogrol synthesis pathway, as described herein. In other embodiments, mogrol or mogrol glycosides (such as a monkfruit extract) are fed to the cells for glycosylation. In still other embodiments, the reaction is performed in vitro using purified UGT enzyme, partially purified UGT enzyme, or recombinant cell lysates.

As described herein, the microbial host cell can be prokaryotic or eukaryotic, and is optionally a bacterium selected from *Escherichia coli, Bacillus subtilis, Corynebacterium glutamicum, Rhodobacter capsulatus, Rhodobacter sphaeroides, Zymomonas mobilis, Vibrio natriegens*, or *Pseudomonas putida*. In some embodiments, the microbial cell is a yeast selected from a species of *Saccharomyces, Pichia*, or *Yarrowia*, including *Saccharomyces cerevisiae, Pichia pastoris*, and *Yarrowia lipolytica*. In some embodiments, the microbial host cell is *E. coli*.

The bacterial host cell is cultured to produce the triterpenoid product (e.g., mogroside). In some embodiments, carbon substrates such as C1, C2, C3, C4, C5, and/or C6 carbon substrates are employed for the production phase. In exemplary embodiments, the carbon source is glucose, sucrose, fructose, xylose, and/or glycerol. Culture conditions are generally selected from aerobic, microaerobic, and anaerobic.

In various embodiments, the bacterial host cell may be cultured at a temperature between 22° C. and 37° C. While commercial biosynthesis in bacteria such as *E. coli* can be limited by the temperature at which overexpressed and/or foreign enzymes (e.g., enzymes derived from plants) are stable, recombinant enzymes may be engineered to allow for cultures to be maintained at higher temperatures, resulting in higher yields and higher overall productivity. In some embodiments, the culturing is conducted at about 22° C. or greater, about 23° C. or greater, about 24° C. or greater, about 25° C. or greater, about 26° C. or greater, about 27° C. or greater, about 28° C. or greater, about 29° C. or greater, about 30° C. or greater, about 31° C. or greater, about 32° C. or greater, about 33° C. or greater, about 34° C. or greater, about 35° C. or greater, about 36° C. or greater, or about 37° C.

In some embodiments, the bacterial host cells are further suitable for commercial production, at commercial scale. In some embodiments, the size of the culture is at least about 100 L, at least about 200 L, at least about 500 L, at least about 1,000 L, at least about 10,000 L, or at least about 100,000 L, or at least about 500,000 L, or at least about 600,000 L. In an embodiment, the culturing may be conducted in batch culture, continuous culture, or semi-continuous culture.

In various embodiments, methods further include recovering the product from the cell culture or from cell lysates. In some embodiments, the culture produces at least about 100 mg/L, or at least about 200 mg/L, or at least about 500 mg/L, or at least about 1 g/L, or at least about 2 g/L, or at least about 5 g/L, or at least about 10 g/L, or at least about 20 g/L, or at least about 30 g/L, or at least about 40 g/L of the terpenoid or terpenoid glycoside product.

In some embodiments, the production of indole (including prenylated indole) is used as a surrogate marker for terpenoid production, and/or the accumulation of indole in the culture is controlled to increase production. For example, in various embodiments, accumulation of indole in the culture is controlled to below about 100 mg/L, or below about 75 mg/L, or below about 50 mg/L, or below about 25 mg/L, or below about 10 mg/L. The accumulation of indole can be controlled by balancing protein expression and activity using the multivariate modular approach as described in U.S. Pat. No. 8,927,241 (which is hereby incorporated by reference), and/or is controlled by chemical means.

Other markers for efficient production of terpene and terpenoids, include accumulation of DOX or ME in the culture media. Generally, the bacterial strains may be engineered to accumulate less of these chemical species, which accumulate in the culture at less than about 5 g/L, or less than about 4 g/L, or less than about 3 g/L, or less than about 2 g/L, or less than about 1 g/L, or less than about 500 mg/L, or less than about 100 mg/L.

The optimization of terpene or terpenoid production by manipulation of MEP pathway genes, as well as manipulation of the upstream and downstream pathways, is not expected to be a simple linear or additive process. Rather, through combinatorial analysis, optimization is achieved through balancing components of the MEP pathway, as well as upstream and downstream pathways. Indole (including prenylated indole) accumulation and MEP metabolite accumulation (e.g., DOX, ME, MEcPP, and/or farnesol) in the culture can be used as surrogate markers to guide this process.

For example, in some embodiments, the bacterial strain has at least one additional copy of dxs and idi expressed as an operon/module; or dxs, ispD, ispF, and idi expressed as an operon or module (either on a plasmid or integrated into the genome), with additional MEP pathway complementation described herein to improve MEP carbon. For example, the bacterial strain may have a further copy of dxr, and ispG and/or ispH, optionally with a further copy of ispE and/or idi, with expressions of these genes tuned to increase MEP carbon and/or improve terpene or terpenoid titer. In various embodiments, the bacterial strain has a further copy of at least dxr, ispE, ispG and ispH, optionally with a further copy of idi, with expressions of these genes tuned to increase MEP carbon and/or improve terpene or terpenoid titer.

Manipulation of the expression of genes and/or proteins, including gene modules, can be achieved through various methods. For example, expression of the genes or operons can be regulated through selection of promoters, such as inducible or constitutive promoters, with different strengths (e.g., strong, intermediate, or weak). Several non-limiting examples of promoters of different strengths include Trc, T5 and T7. Additionally, expression of genes or operons can be regulated through manipulation of the copy number of the gene or operon in the cell. In some embodiments, expression of genes or operons can be regulated through manipulating the order of the genes within a module, where the genes transcribed first are generally expressed at a higher level. In some embodiments, expression of genes or operons is regulated through integration of one or more genes or operons into the chromosome.

Optimization of protein expression can also be achieved through selection of appropriate promoters and ribosomal binding sites. In some embodiments, this may include the selection of high-copy number plasmids, or single-, low- or medium-copy number plasmids. The step of transcription termination can also be targeted for regulation of gene expression, through the introduction or elimination of structures such as stem-loops.

Expression vectors containing all the necessary elements for expression are commercially available and known to those skilled in the art. See, e.g., Sambrook et al., Molecular Cloning: A Laboratory Manual, Second Edition, Cold Spring Harbor Laboratory Press, 1989. Cells are genetically engineered by the introduction into the cells of heterologous DNA. The heterologous DNA is placed under operable control of transcriptional elements to permit the expression of the heterologous DNA in the host cell.

In some embodiments, endogenous genes are edited, as opposed to gene complementation. Editing can modify endogenous promoters, ribosomal binding sequences, or other expression control sequences, and/or in some embodiments modifies trans-acting and/or cis-acting factors in gene regulation. Genome editing can take place using CRISPR/Cas genome editing techniques, or similar techniques employing zinc finger nucleases and TALENs. In some embodiments, the endogenous genes are replaced by homologous recombination.

In some embodiments, genes are overexpressed at least in part by controlling gene copy number. While gene copy number can be conveniently controlled using plasmids with varying copy number, gene duplication and chromosomal integration can also be employed. For example, a process for genetically stable tandem gene duplication is described in US 2011/0236927, which is hereby incorporated by reference in its entirety.

The terpene or terpenoid product can be recovered by any suitable process. For example, the aqueous phase can be recovered, and/or the whole cell biomass can be recovered, for further processing. The production of the desired product can be determined and/or quantified, for example, by gas chromatography (e.g., GC-MS). The desired product can be produced in batch or continuous bioreactor systems.

The similarity of nucleotide and amino acid sequences, i.e. the percentage of sequence identity, can be determined via sequence alignments. Such alignments can be carried out with several art-known algorithms, such as with the mathematical algorithm of Karlin and Altschul (Karlin & Altschul (1993) Proc. Natl. Acad. Sci. USA 90:5873-5877), with hmmalign (HMMER package) or with the CLUSTAL algorithm (Thompson, J. D., Higgins, D. G. & Gibson, T. J. (1994) Nucleic Acids Res. 22, 4673-80). The grade of sequence identity (sequence matching) may be calculated using e.g. BLAST, BLAT or BlastZ (or BlastX). A similar algorithm is incorporated into the BLASTN and BLASTP programs of Altschul et al (1990) J. Mol. Biol. 215:403-410. BLAST polynucleotide searches can be performed with the BLASTN program, score=100, word length=12.

BLAST protein searches may be performed with the BLASTP program, score=50, word length=3. To obtain gapped alignments for comparative purposes, Gapped BLAST is utilized as described in Altschul et al (1997) Nucleic Acids Res. 25: 3389-3402. When utilizing BLAST and Gapped BLAST programs, the default parameters of the respective programs are used. Sequence matching analysis may be supplemented by established homology mapping techniques like Shuffle-LAGAN (Brudno M., Bioinformatics 2003b, 19 Suppl 1.154-162) or Markov random fields.

"Conservative substitutions" may be made, for instance, on the basis of similarity in polarity, charge, size, solubility, hydrophobicity, hydrophilicity, and/or the amphipathic nature of the amino acid residues involved. The 20 naturally occurring amino acids can be grouped into the following six standard amino acid groups:

(1) hydrophobic: Met, Ala, Val, Leu, Ile;
(2) neutral hydrophilic: Cys, Ser, Thr; Asn, Gln;
(3) acidic: Asp, Glu;
(4) basic: His, Lys, Arg;
(5) residues that influence chain orientation: Gly, Pro; and
(6) aromatic: Trp, Tyr, Phe.

As used herein, "conservative substitutions" are defined as exchanges of an amino acid by another amino acid listed within the same group of the six standard amino acid groups shown above. For example, the exchange of Asp by Glu retains one negative charge in the so modified polypeptide. In addition, glycine and proline may be substituted for one another based on their ability to disrupt α-helices. Some preferred conservative substitutions within the above six groups are exchanges within the following sub-groups: (i) Ala, Val, Leu and Ile; (ii) Ser and Thr; (ii) Asn and Gln; (iv) Lys and Arg; and (v) Tyr and Phe.

As used herein, "non-conservative substitutions" are defined as exchanges of an amino acid by another amino acid listed in a different group of the six standard amino acid groups (1) to (6) shown above.

Modifications of enzymes as described herein can include conservative and/or non-conservative mutations. In some embodiments, an Alanine is substituted or inserted at position 2, to increase stability.

In some embodiments "rational design" is involved in constructing specific mutations in enzymes. Rational design refers to incorporating knowledge of the enzyme, or related enzymes, such as its reaction thermodynamics and kinetics, its three dimensional structure, its active site(s), its substrate (s) and/or the interaction between the enzyme and substrate, into the design of the specific mutation. Based on a rational design approach, mutations can be created in an enzyme which can then be screened for increased production of a terpene or terpenoid relative to control levels. In some embodiments, mutations can be rationally designed based on homology modeling. As used herein, "homology modeling" refers to the process of constructing an atomic resolution model of one protein from its amino acid sequence and a three-dimensional structure of a related homologous protein.

In other aspects, the invention provides a method for making a product comprising a mogrol glycoside. The method comprises producing a mogrol glycoside in accordance with this disclosure, and incorporating the mogrol glycoside into a product. In some embodiments, the mogrol glycoside is siamenoside, Mog.V, Mog.VI, or Isomog.V. In some embodiments, the product is a sweetener composition, flavoring composition, food, beverage, chewing gum, texturant, pharmaceutical composition, tobacco product, nutraceutical composition, or oral hygiene composition.

The product may be a sweetener composition comprising a blend of artificial and/or natural sweeteners. For example, the composition may further comprise one or more of a steviol glycoside, aspartame, and neotame. Exemplary steviol glycosides comprises one or more of RebM, RebB, RebD, RebA, RebE, and RebI.

Non-limiting examples of flavors for which the products can be used in combination include lime, lemon, orange, fruit, banana, grape, pear, pineapple, mango, bitter almond, cola, cinnamon, sugar, cotton candy and vanilla flavors. Non-limiting examples of other food ingredients include flavors, acidulants, and amino acids, coloring agents, bulking agents, modified starches, gums, texturizers, preservatives, antioxidants, emulsifiers, stabilizers, thickeners and gelling agents.

Mogrol glycosides obtained according to this invention may be incorporated as a high intensity natural sweetener in foodstuffs, beverages, pharmaceutical compositions, cosmetics, chewing gums, table top products, cereals, dairy products, toothpastes and other oral cavity compositions, etc.

Mogrol glycosides obtained according to this invention can be used in combination with various physiologically active substances or functional ingredients. Functional ingredients generally are classified into categories such as carotenoids, dietary fiber, fatty acids, saponins, antioxidants, nutraceuticals, flavonoids, isothiocyanates, phenols, plant sterols and stanols (phytosterols and phytostanols), polyols; prebiotics, probiotics; phytoestrogens; soy protein; sulfides/thiols; amino acids; proteins; vitamins; and minerals. Functional ingredients also may be classified based on their health benefits, such as cardiovascular, cholesterol-reducing, and anti-inflammatory.

Mogrol glycosides obtained according to this invention may be applied as a high intensity sweetener to produce zero calorie, reduced calorie or diabetic beverages and food products with improved taste characteristics. It may also be used in drinks, foodstuffs, pharmaceuticals, and other products in which sugar cannot be used. In addition, highly purified target mogrol glycoside(s), particularly, Mog.V, Mog.VI, or Isomog.V, can be used as a sweetener not only for drinks, foodstuffs, and other products dedicated for human consumption, but also in animal feed and fodder with improved characteristics.

Examples of products in which mogrol glycoside(s) may be used as a sweetening compound include, but are not limited to, alcoholic beverages such as vodka, wine, beer, liquor, and sake, etc.; natural juices; refreshing drinks; carbonated soft drinks; diet drinks; zero calorie drinks; reduced calorie drinks and foods; yogurt drinks; instant juices; instant coffee; powdered types of instant beverages; canned products; syrups; fermented soybean paste; soy sauce; vinegar; dressings; mayonnaise; ketchups; curry; soup; instant bouillon; powdered soy sauce: powdered vinegar; types of biscuits; rice biscuit; crackers; bread; chocolates; caramel; candy; chewing gum; jelly; pudding; preserved fruits and vegetables; fresh cream; jam; marmalade; flower paste; powdered milk; ice cream; sorbet; vegetables and fruits packed in bottles; canned and boiled beans; meat and foods boiled in sweetened sauce; agricultural vegetable food products: seafood; ham; sausage; fish ham; fish sausage; fish paste; deep fried fish products; dried seafood products, frozen food products; preserved seaweed; preserved meat; tobacco: medicinal products; and many others.

During the manufacturing of products such as foodstuffs, drinks, pharmaceuticals, cosmetics, table top products, and chewing gum, the conventional methods such as mixing, kneading, dissolution, pickling, permeation, percolation, sprinkling, atomizing, infusing and other methods may be used.

As used in this specification and the appended claims, the singular forms "a", "an" and "the" include plural referents unless the content clearly dictates otherwise. For example, reference to "a cell" includes a combination of two or more cells, and the like.

As used herein, the term "about" in reference to a number is generally taken to include numbers that fall within a range of 10% in either direction (greater than or less than) of the number.

EXAMPLES

The biosynthesis of mogrosides in fruit involves a number of consecutive glycosylations of the aglycone mogrol to the final sweet products, including mogroside V (Mog.V). Mog.V has a sweetening capacity that is about 250 times that of sucrose (Kasai et al., *Agric Biol Chem* (1989)). Mogrosides are reported to have health benefits as well (Li et al., *Chin J Nat Med* (2014)).

A variety of factors are promoting a surge in interest in mogrosides and monkfruit in general, including an explosion in demand for natural sweeteners, difficulties in scalable sourcing of the current lead natural sweetener, rebaudioside M (RebM) from the *Stevia* plant, the superior taste performance of Mog.V relative to other natural and artificial sweetener products on the market, and the medicinal potential of the plant and fruit.

Purified Mog.V has been approved as a high-intensity sweetening agent in Japan (Jakinovich et al., *Journal of Natural Products* (1990)) and the extract has gained GRAS status in the USA as a non-nutritive sweetener and flavor enhancer (GRAS 522). Extraction of mogrosides from the fruit can yield a product of varying degrees of purity, often accompanied by undesirable aftertaste. In addition, yields of mogroside from cultivated fruit are limited due to low plant yields and particular cultivation requirements of the plant. Mogrosides are present at ~1% in the fresh fruit and ~4% in the dried fruit. Mog.V is the main component, with a content of 0.5%-1.4% in the dried fruit. Moreover, purification difficulties limit purity for Mog.V, with commercial products from plant extracts being standardized to ~50% Mog.V. A pure Mog.V product is desirable to avoid off flavors, and will be easier to formulate into products, since Mog.V has good solubility potential. It is therefore advantageous to produce sweet mogroside compounds, such as but not limited to Mog.V, via biotechnological processes.

FIG. 1 shows the chemical structures of Mog.V, Mog.VI, Isomog.V, and Siamenoside. Mog.V has five glucosylations with respect to the mogrol core, including glucosylations at the C3 and C24 hydroxyl groups, followed by 1-2, 1-4, and 1-6 glucosyl additions. These glucosylation reactions are catalyzed by uridine diphosphate-dependent glycosyltransferase enzymes (UGTs).

Figure 3:
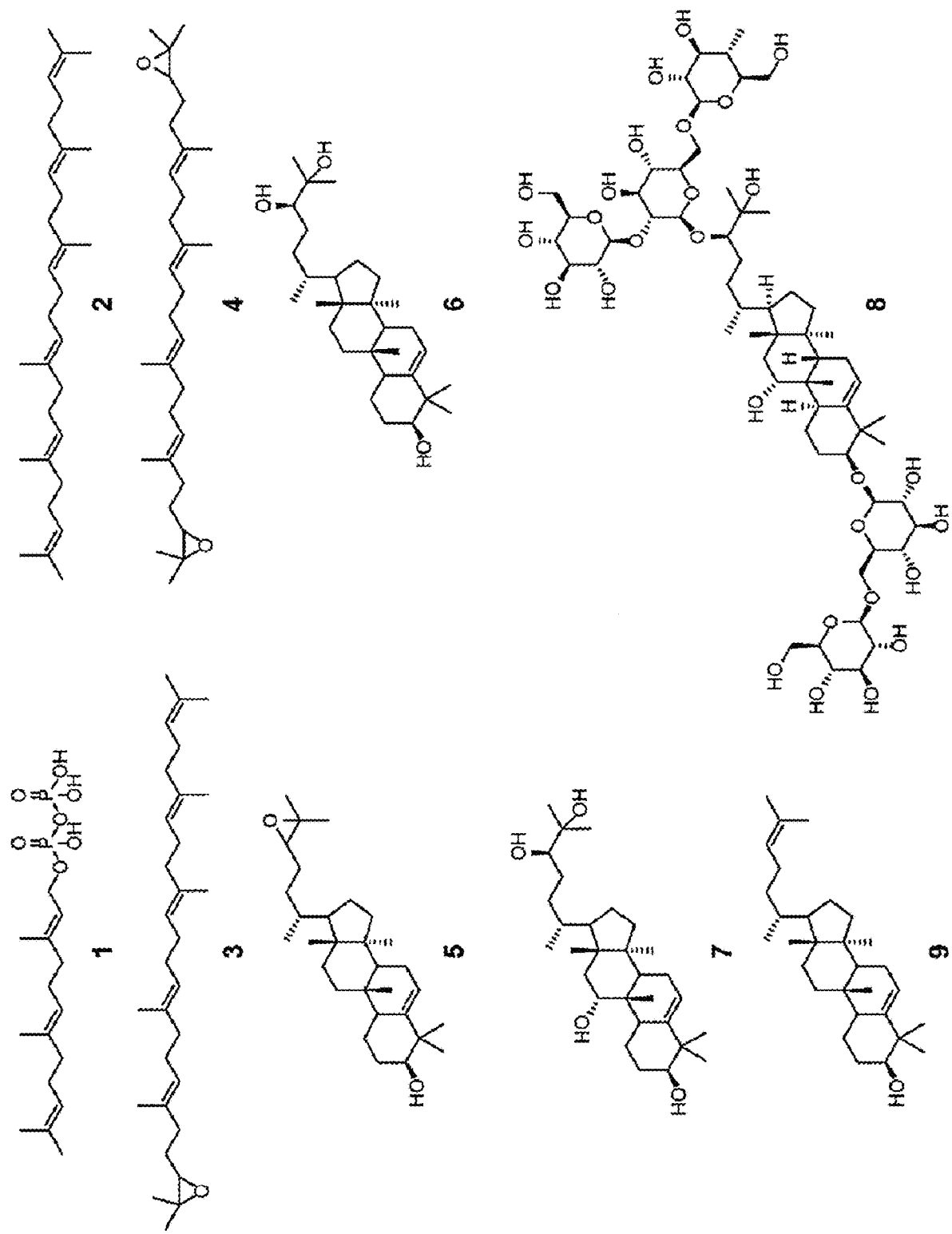
FIG. 3 depicts chemical structures of metabolites involved in Mog.V biosynthesis: (1) farnesyl pyrophosphate; (2) squalene; (3) 2,3-oxidosqualene; (4) 2,3;22,23-dioxidosqualene; (5) 24,25-epoxycucurbitadienol; (6) 24,25-dihydroxycucurbitadienol; (7) mogrol; (8) mogroside V; (9) cucurbitadienol.

FIG. 2 shows routes to Mog.V production in vivo. The enzymatic transformation required for each step is indicated, along with the type of enzyme required. Numbers in parentheses correspond to the chemical structures in FIG. 3, namely: (1) farnesyl pyrophosphate; (2) squalene; (3) 2,3-oxidosqualene; (4) 2,3;22,23-dioxidosqualene, (5) 24,25-epoxycucurbitadienol; (6) 24,25-dihydrooxycucurbitadienol; (7) mogrol; (8) mogroside V; (9) cucurbitadienol.

Mogrosides can be produced by biosynthetic fermentation processes, as illustrated in FIG. 2, using microbial strains that produce high levels of methylerythritol 4-phosphate (MEP) pathway products, along with heterologous expression of mogrol biosynthesis enzymes and UGT enzymes that direct glucosylation reactions to Mog.V, or other desired mogroside compound. For example, in bacteria such as *E. coli*, isopentenyl pyrophosphate (IPP) and dimethylallyl pyrophosphate (DMAPP) can be produced from glucose, and are converted to farnesyl diphosphate (FPP) (1) by recombinant farnesyl diphosphate synthase (FPPS). FPP is converted to squalene (2) by a condensation reaction catalyzed by squalene synthase (SQS). Squalene is converted to 2,3-oxidosqualene (3) by an epoxidation reaction catalyzed by a squalene epoxidase (SQE). The pathway can proceed to 22,23-dioxidosqualene (4) by further epoxidation followed by cyclization to 24,25-epoxycucurbitadienol (5) by a triterpene cyclase, and then hydration of the remaining epoxy group to 24,25-dihydroxycucurbitadienol (6) by an epoxide hydrolase. A further hydroxylation catalyzed by a P450 oxidase produces mogrol (7).

The pathway can alternatively proceed by cyclization of (3) to produce cucurbitadienol (9), followed by epoxidation to (5), or multiple hydroxylations of cucurbitadienol to 24,25-dihydroxycucurbitadienol (6), or to mogrol (7).

Figure 4:
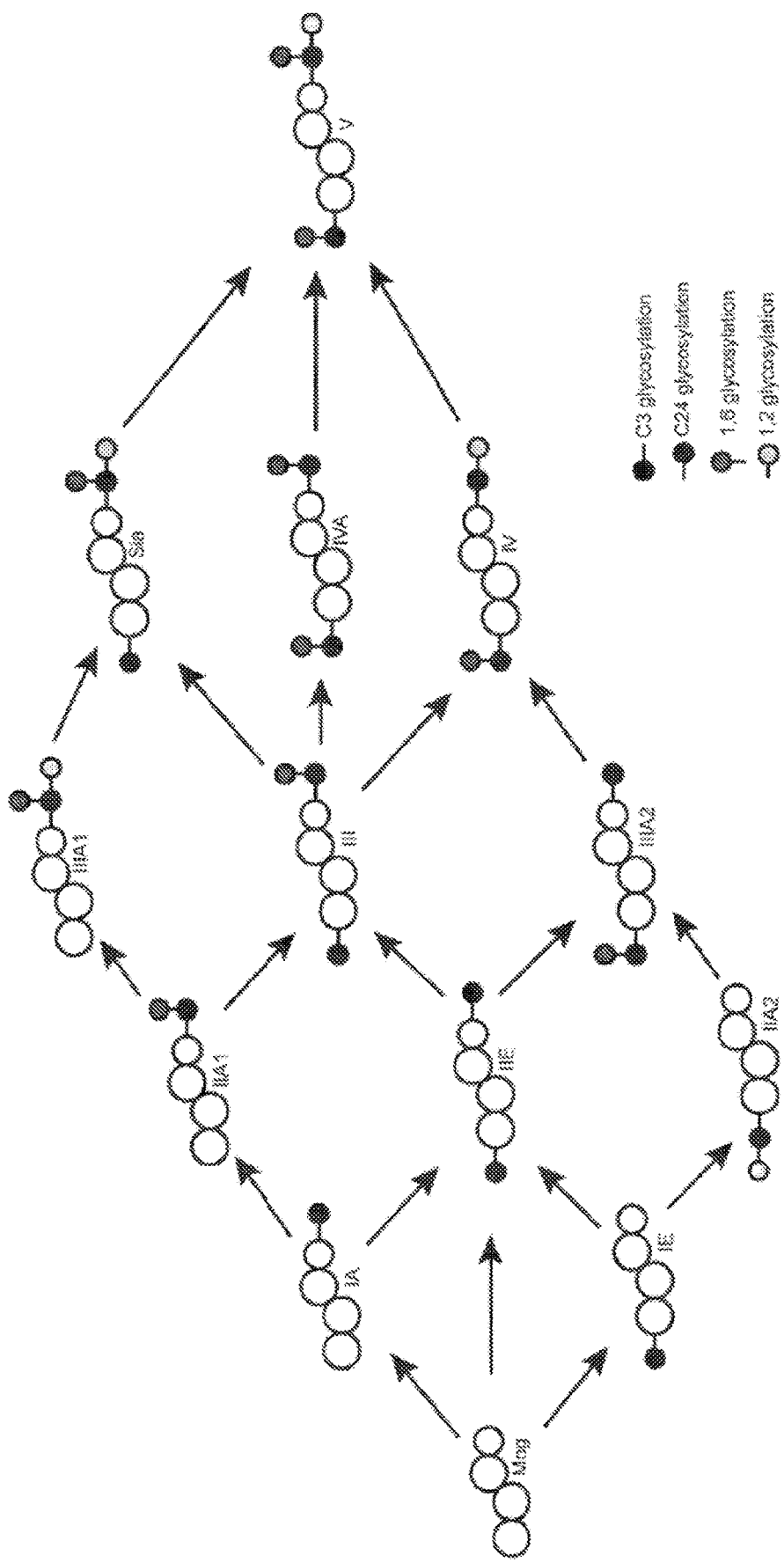
FIG. 4 illustrates glycosylation routes to Mog.V Bubble structures represent different mogrosides. White tetra-cyclic core represents mogrol. The numbers below each structure indicate the particular glycosylated mogroside. Black circles represent C3 or C24 glucosylations. Dark grey vertical circles represent 1,6-glucosylations. Light grey horizontal circles represent 1,2-glucosylations. Abbreviations: Mog, mogrol; sia, siamenoside.

FIG. 4 illustrates glucosylation routes to Mog.V. Glucosylation of the C3 hydroxyl produces Mog.I-E, or glucosylation of the C24 hydroxyl produces Mog.I-A1. Glucosylation of Mog.I-A1 at C3 or glucosylation of Mog.I-E1 at C24 produces Mog.III-E. Further 1-6 glucosylation of Mog.II-E at C3 produces Mog.III-A2. Further 1-6 glucosylation at C24 of Mog.IIE produces Mog.III. 1-2 glucosylation of Mog.III-A2 at C24 produces Mog.IV, and then to Mog.V with a further 1-6 glucosylation at C24. Alternatively, glucosylations may proceed through Mog.III, with a 1-6 glucosylation at C3 and a 1-2 glucosylation at C24, or through Siamenoside or Mog.IV with 1-6 glucosylations.

While biosynthetic enzymes from monkfruit (*Siraitia grosvenorii*) have been identified for production of mogrol (See, WO 2016/038617 and US 2015/0322473, which are hereby incorporated by reference in their entireties), many of these enzymes lack the productivity or physical properties desired for overexpression in microbial hosts, particularly for fermentation approaches that operate at higher temperatures than the natural climate of the plant. Accordingly, alternative or engineered enzymes are desired to improve production of mogrol using microbial fermentation, with mogrol acting as the substrate for glucosylation to produce Mog.V or other target mogroside.

Using an *E. coli* strain that produces high levels of the MEP pathway products IPP and DMAPP (see US 2018/0245103 and US 2018/0216137, which are hereby incorporated by reference), and with overexpression of ScFPPS, enzymes were screened for their ability to convert FPP to squalene (SQS activity), as well epoxidation of squalene to produce 2,3-oxidosqualene (SQE activity). The 2,3-oxidosqualene intermediate can by cyclized by a triterpene cyclase, such as CDS from *Siraitia grosvenorii*. As demonstrated in FIG. 5, several enzymes were identified with good activity in *E. coli*. In particular, SEQ ID NO: 11 showed high activity in *E. coli* at 37° C. culture conditions.

As shown in FIG. 6, co-expression of SQS (SEQ ID NO: 11) and SQE (SEQ ID NO: 39) in *E. coli* provided a substantial gain in titer of the 2,3-oxidosqualene intermediate. Other SQE enzymes were active in *E. coli*.

Figure 7:
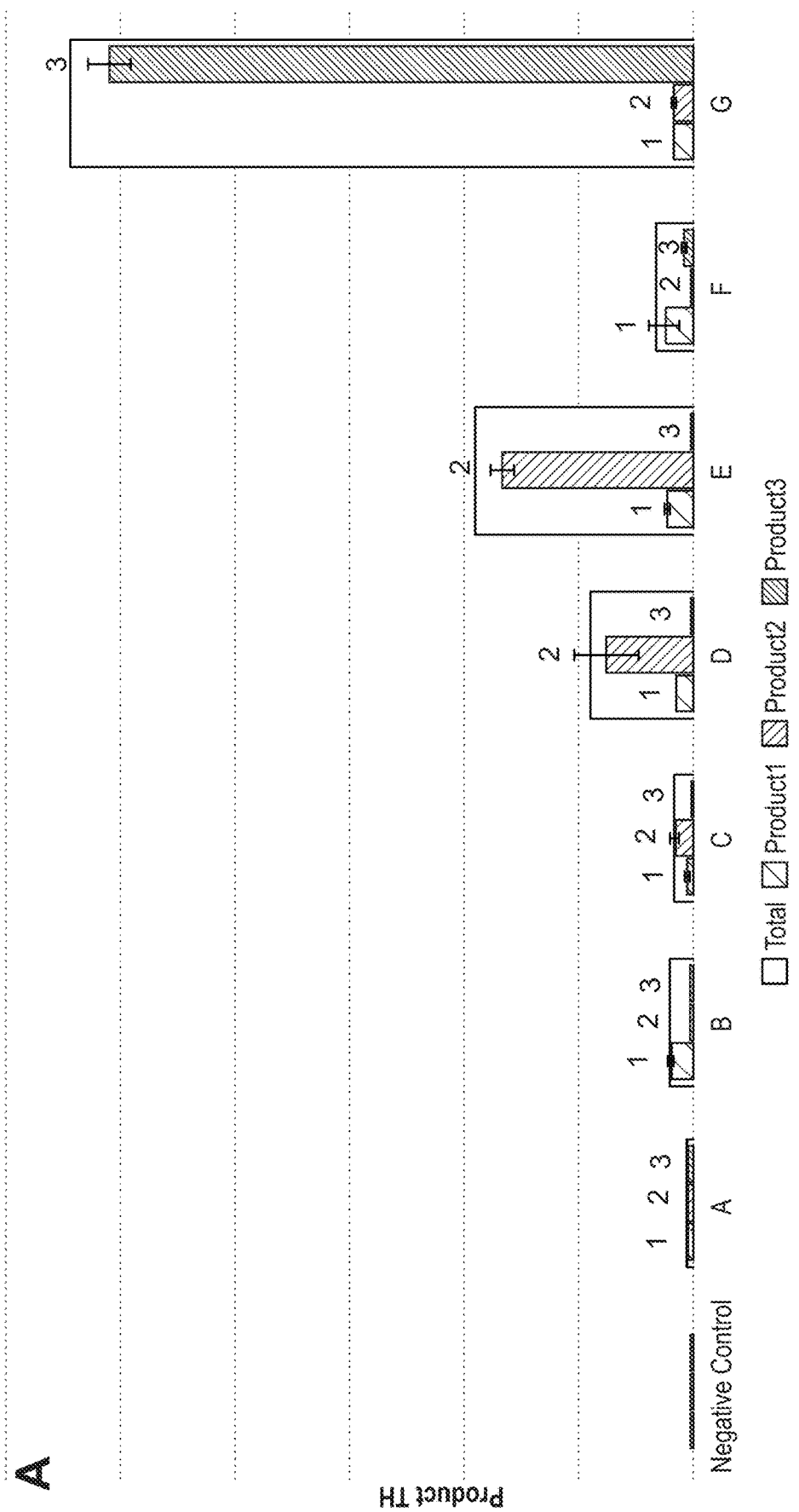
FIG. 7 shows results for in vivo production of the cyclized triterpene product. Reactions involve an increasing number of enzymes expressed in an E. coli cell line having an overexpression of MEP pathway enzymes. The asterisks represent fermentation experiments incubated for a quarter of the time than the other experiments. As shown, coexpression of SQS (SEQ ID NO: 11), SQE (SEQ ID NO: 39), and TTC (SEQ ID NO: 40) (lane G) resulted in high production of the triterpenoid product, cucurbitadienol. Legends: Product 1 is squalene; Product 2 is 2,3-oxidosqualene; Product 3 is cucurbitadienol; (A) expression of SEQ ID NO: 2, (B) expression of SEQ ID NO. 11, (C) coexpression of SEQ ID NO: 2 and SEQ ID NO: SEQ ID NO: 17, (D) coexpression of SEQ ID NO: 2 and SEQ ID NO: 169; (E) coexpression of SEQ ID NO-11 and SEQ ID NO: 169; (F) coexpression of SEQ ID NO: 2, SEQ ID NO: 17, and SEQ ID NO: 40; (G) coexpression of SEQ ID NO: 11, SEQ ID NO: 39, and SEQ ID NO: 40.
Figure 8:
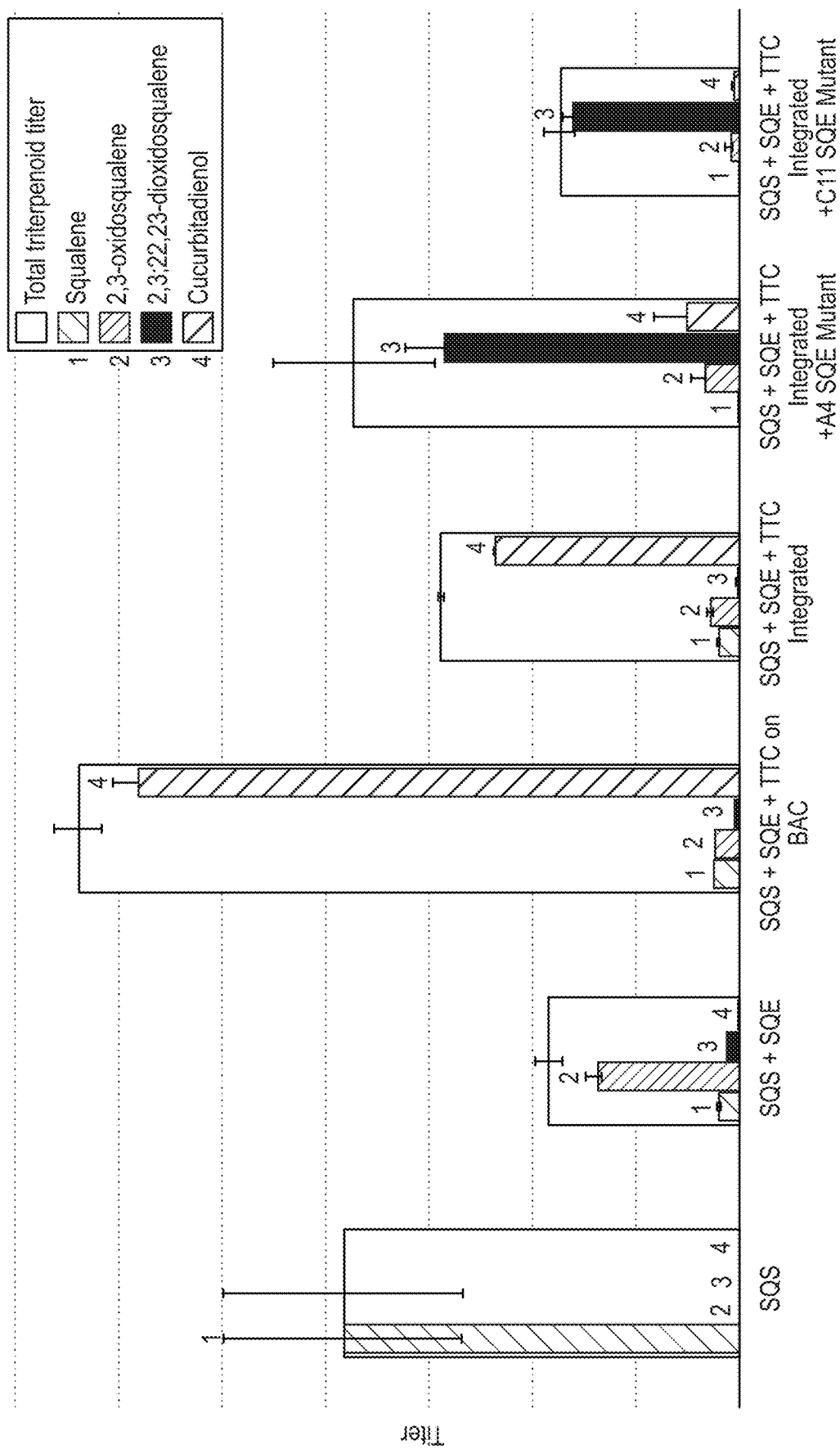
FIG. 8 shows results for SQE engineering to produce high titers of 2,3;22,23-dioxidosqualene Expression of SQS(SEQ ID NO: 11), SQE (SEQ ID NO: 39), and TTC (SEQ ID NO: 40) whether on a bacterial artificial chromosome (BAC) or integrated, produce large amounts of cucurbitadienol. Point mutations in SQE (SEQ ID NO: 39) were screened to complement SQE to reduce levels of cucurbitadienol, with corresponding gain in titers of 2,3;22,23-dioxidosqualene. Two variants are shown in FIG. 8, SQE A4 (including H35R, F163A, M283L, V380L, and F395Y substitutions, SEQ ID NO: 203) and SQE C11 (including H35R, N133G, F163A, Y254F, V380L, and F395Y substitutions).
Figure 9:
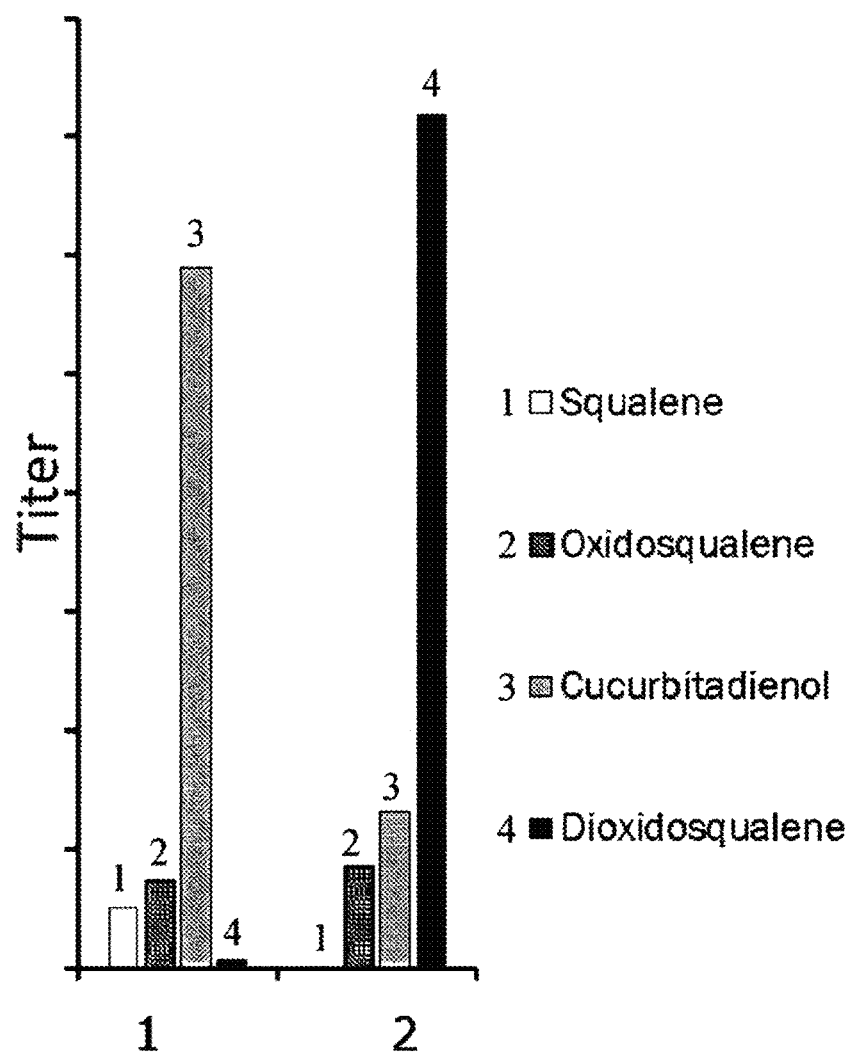
FIG. 9 shows production of 2,3;22,23 dioxidosqualene. Titers are plotted for each strain producing 2,3;22,23 dioxidosqualene. An engineered squalene epoxidase gene, SEQ ID NO: 203, was expressed in a strain producing 2,3 oxidosqualene via the squalene epoxidase of SEQ ID NO: 39. Strains were incubated for 48 hours before extraction. Lanes: (1) expression of SQE of SEQ ID NO: 39; (2) expression of SQE of SEQ ID NO-39 and SEQ ID NO: 203.

FIG. 7 shows coexpression of SQS, SQE, and TTC enzymes. CDS (or triterpene cyclase, or "TTC") (SEQ ID NO: 40), when coexpressed with SQS (SEQ ID NO: 11) and SQE (SEQ ID NO: 39), resulted in high production of the triterpenoid product, cucurbitadienol (Product 3). These fermentation experiments were performed at 37° C. for 48 to 120 hours. FIG. 8 shows results for SQE engineering to produce high titers of 2,3;22,23-dioxidosqualene. Expression of SQS, SQE, and TTC whether on a bacterial artificial chromosome (BAC) or integrated, produce large amounts of cucurbitadienol. Point mutations in SQE (SEQ ID NO: 39) were screened to complement SQE (SEQ ID NO 39) to reduce levels of cucurbitadienol, with corresponding gain in titers of 2,3;22,23-dioxidosqualene. Two SQE mutants are shown in FIG. 8, SQE A4 and SQE C11. By complementing SQE (SEQ ID NO: 39) with a second engineered version with higher specificity/activity for 2,3-oxidosqualene, titers can be pushed toward 2,3;22,23-dioxidosqualene, as opposed to cucurbitadienol. This concept is demonstrated further in FIG. 9. SQE A4 (SEQ ID NO: 203) was co-expressed with SQE (SEQ ID NO: 39), SQS (SEQ ID NO: 11), and TTC (SEQ ID NO: 40). These fermentation experiments were performed at 37° C. for 48 hours in 96 well plates. Titers were plotted for each strain producing 2,3;22,23 dioxidosqualene. As shown in FIG. 9, the strain expressing SQE A4 (SEQ ID NO: 203) produced much more 2,3;22,23 dioxidosqualene.

FIG. 10 shows the coexpression of SQS, SQE, and TTC enzymes. TTC (SEQ ID NO 40), when coexpressed with SQS (SEQ ID NO: 11), SQE (SEQ ID NO: 39), and SQE A4 (SEQ ID NO: 203) in *E. coli*, resulted in production of cucurbitadienol and 24,25-epoxycucurbitadienol. Candidate enzymes for an additional or alternative TTC include SEQ ID NO: 40, SEQ ID NO: 191, SEQ ID NO: 192, and SEQ ID NO: 193. Each candidate TTC enzyme was expressed in this strain and screened for production of 24,25-epoxy-cucurbitadienol. These fermentation experiments were performed at 30° C. for 72 hours in 96 well plates. 24,25-epoxy-cucurbitadienol production was verified by GC-MS spectrum analysis. Concentrations were plotted relative to production of 24,25-epoxy-cucurbitadienol from an *E. coli* strain expressing SEQ ID NO: 40 as the only cyclase. As shown in FIG. 10, *E. coli* strains coexpressing SQS (SEQ ID NO: 11), SQE (SEQ ID NO: 39), SQE A4 (SEQ ID NO: 203), and TTC (SEQ ID NO: 40), with an additional TTC, produced higher levels of 24,25-epoxycucurbitadienol.

FIG. 11 shows substrate specificity for production of cucurbitadienol and 24,25-epoxycucurbitadienol with candidate TTC enzymes. Engineered *E. coli* strains producing oxidosqualene and dioxidosqualene were complemented with CDS homologs and CAS genes engineered for cucurbitadienol production. Strains were incubated at both 30° C. for 72 hours before extraction. The ratio of 24,25-epoxycurbitadienol to cucurbitadienol varies from 0.15 for Enzyme 1 (SEQ ID NO: 40) to 0.58 for Enzyme 2 (SEQ ID NO: 192), pointing to improved substrate specificity toward the desired 24,25-epoxycucurbitadienol product for Enzyme 2.

Figure 12:
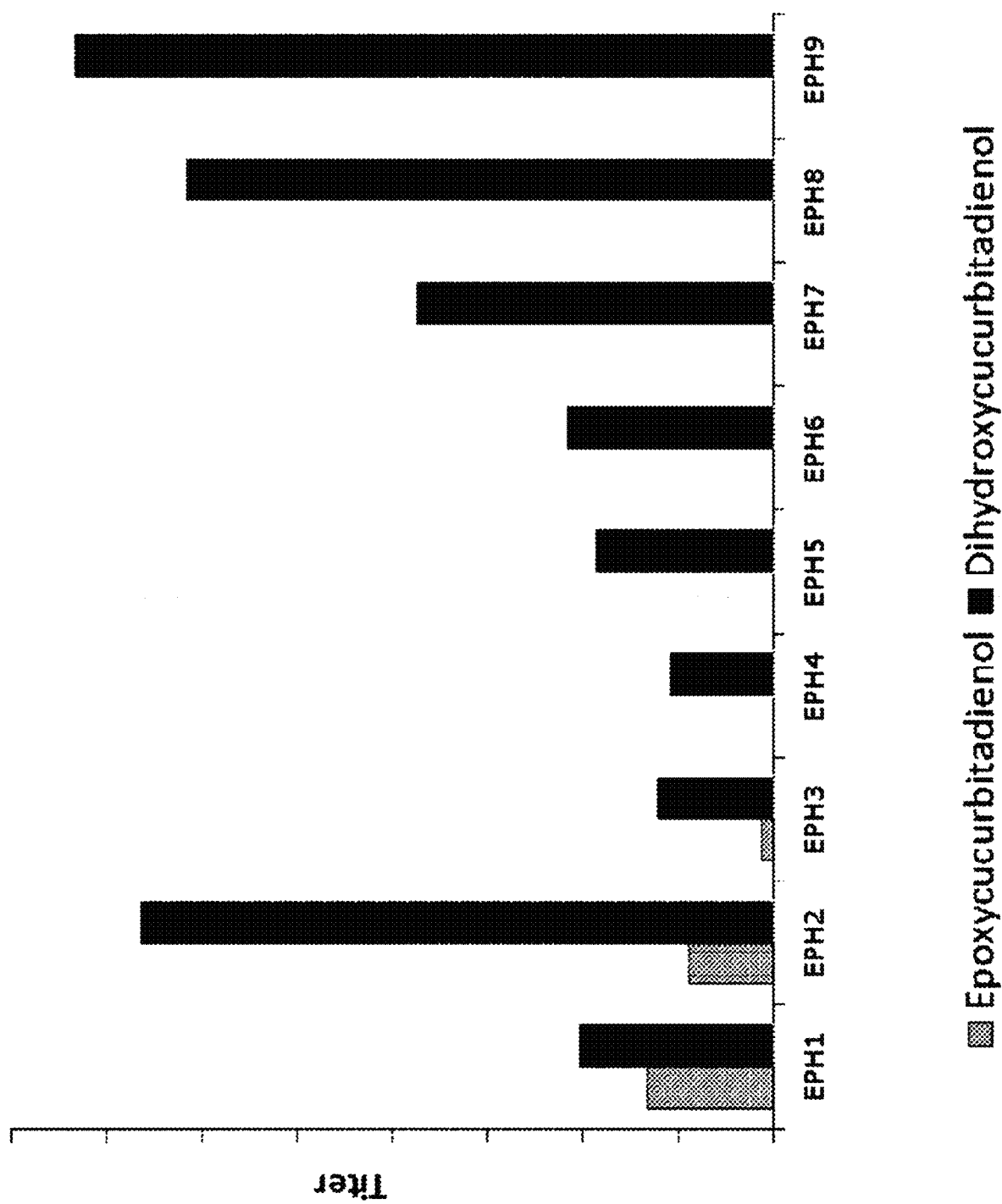
FIG. 12 shows the screening of EPH enzymes for hydration of 24,25-epoxycucurbitadienol to produce 24,25-dihydroxycucurbitadienol in E. coli strains coexpressing SQS (SEQ ID NO: 11), SQE (SEQ ID NO: 39), SQE A4 (SEQ ID NO. 203), and TTC (SEQ ID NO: 40). These fermentation experiments were performed at 30° C. for 72 hours in 96 well plates. Legend: EPH1 (SEQ ID NO: 186); EPH2 (SEQ ID NO: 212); EPH3 (SEQ ID NO: 190); EPH4 (SEQ ID NO: 187); EPH5 (SEQ ID NO: 184); EPH6 (SEQ ID NO: 185); EPH7 (SEQ ID NO: 188); EPH8 (SEQ ID NO: 189); and EPH9 (SEQ ID NO: 58).

FIG. 12 shows the screening of EPH enzymes for hydration of epoxycucurbitadienol to produce 24,25-dihydroxycucurbitadienol in *E. coli* strains coexpressing SQS (SEQ ID NO: 11), SQE (SEQ ID NO: 39), SQE A4 (SEQ ID NO 203), and TTC (SEQ ID NO: 40). EPH homologs were expressed in a strain producing 24,25-epoxycucurbitadienol for production of 24,25-dihydroxycucurbitadienol. Candidate EPH enzymes for this reaction include SEQ ID NO: 184, SEQ ID NO: 185, SEQ ID NO: 186, SEQ ID NO: 212, SEQ ID NO: 187, SEQ ID NO: 188, SEQ ID NO: 189, and SEQ ID NO: 190. These fermentation experiments were performed at 30° C. for 72 hours in 96 well plates. 24,25-dihydroxycucurbitadienol production was verified by GC-MS spectrum analysis. Titers were plotted for each strain producing 24,25-dihydroxycucurbitadienol. As shown in FIG. 12, the *E. coli* strains expressing the EPHs were able to produce 24,25-dihydroxycucurbitadienol. ToEPH and SgEPH3 in particular demonstrated high activity in *E. coli*

Figures 13A, 13B:
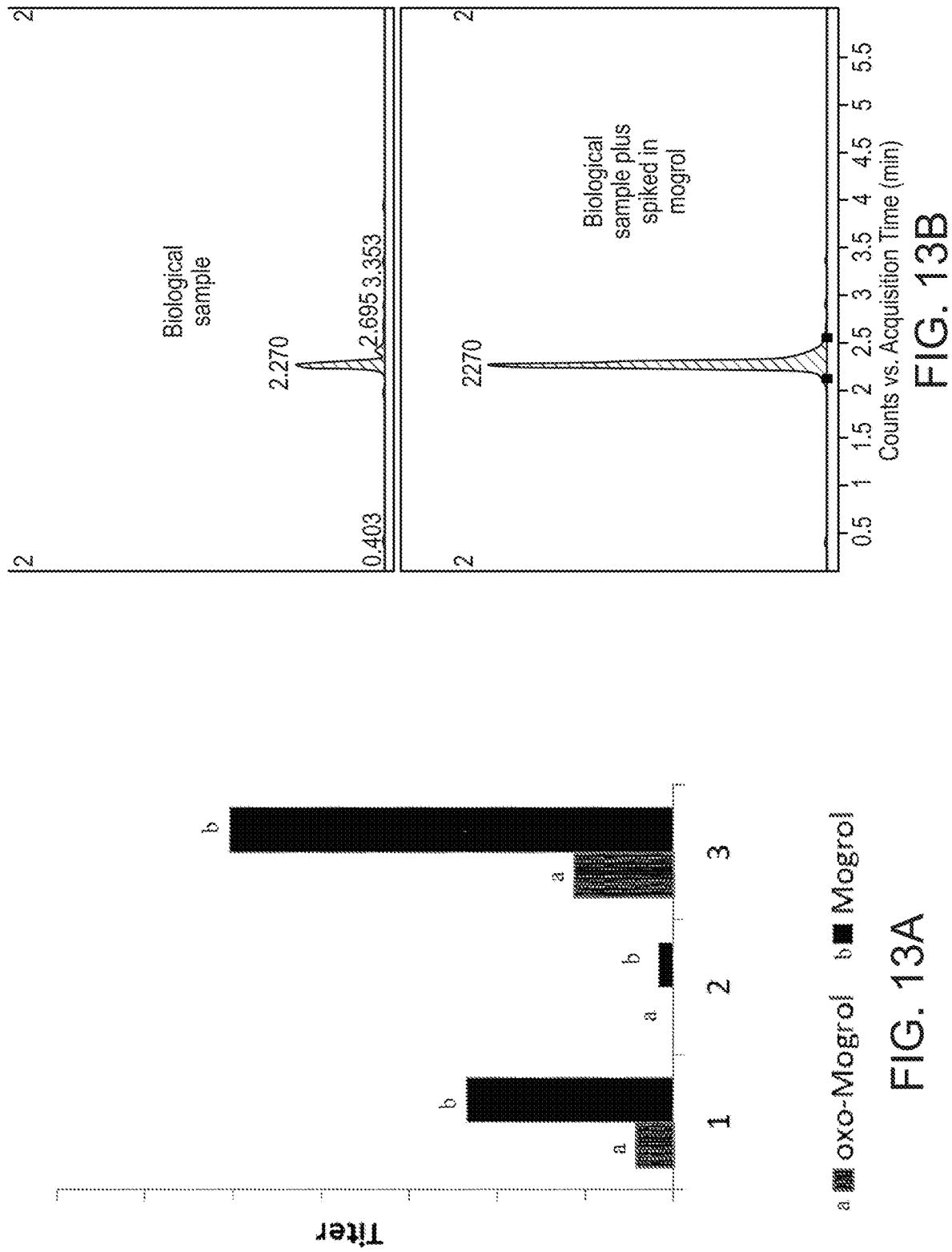
FIG. 13(A-C) show the coexpression of SQS, SQE, TTC, EPH, and P450 enzymes to produce mogrol. An E. coli strain expressing SEQ ID NOS: 11, 39, 203 along with CDS, EPH, and P450 genes with a CPR resulted in production of mogrol and oxo-mogrol (FIG. 13A). These fermentation experiments were performed at 30° C. for 72 hours in 96 well plates. Mogrol production was validated by LC-QQQ mass spectrum analysis with a spiked authentic standard (FIG. 13B) and GC-FID chromatography versus an authentic standard (FIG. 13C). Legend: (1) coexpression of SEQ ID NO: 40, SEQ ID NO: 58, SEQ ID NO: 194), and SEQ ID NO: 98); (2) coexpression of SEQ ID NO. 40, SEQ ID NO. 58, SEQ ID NO: 197, and SEQ ID NO: 98; (3) SEQ ID NO: 40, SEQ ID NO: 58, SEQ ID NO: 171, and SEQ ID NO: 201.
Figure 13C:
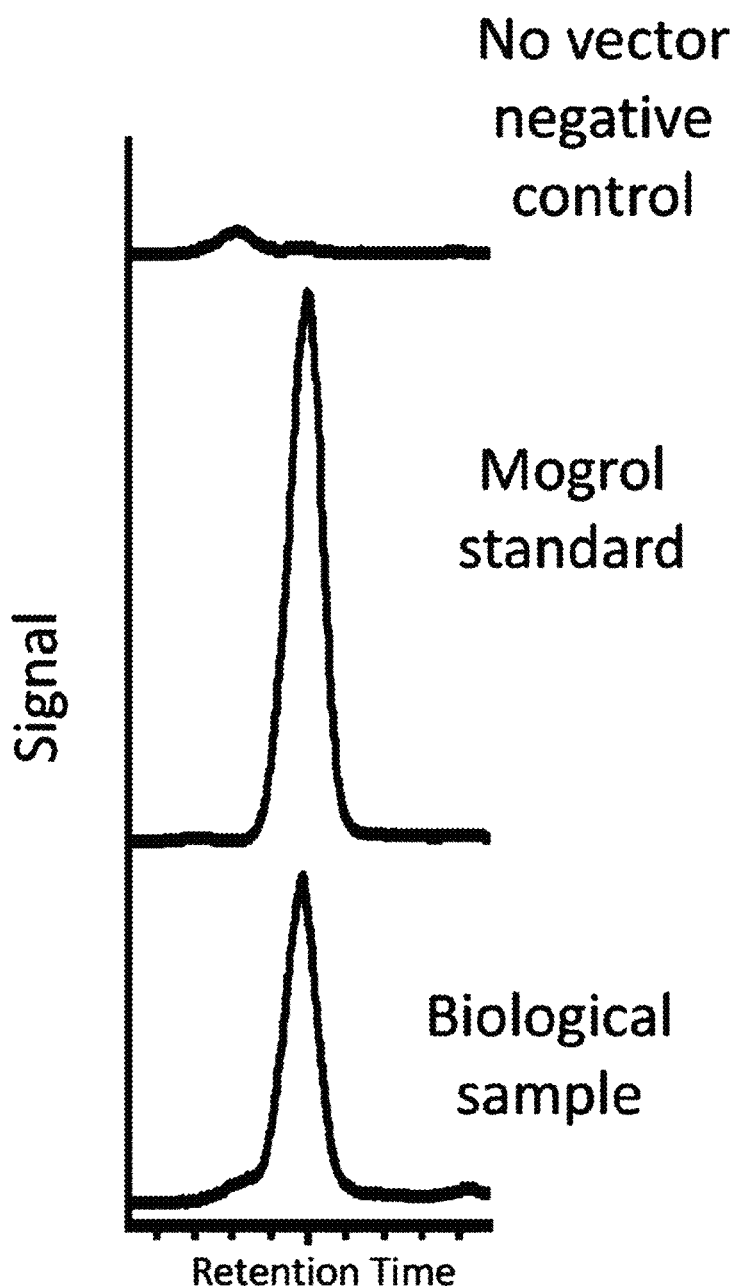

FIG. 13A-C shows the coexpression of SQS, SQE, TTC, EPH, and P450 enzymes to produce mogrol. *E. coli* strains were constructed that express SQS (SEQ ID NO. 11), SQE (SEQ ID NO: 39), SQE A4 (SEQ ID NO: 203), TTC (SEQ ID NO: 40), EPH (SEQ ID NO: 58), and a P450 selected from SEQ ID NO: 194, SEQ ID NO: 197, and SEQ ID NO: 171, together with a cytochrome P450 reductase (9SEQ ID NO: 98 or SEQ ID NO: 201). These fermentation experiments were performed at 30° C. for 72 hours in 96 well plates. Mogrol production was verified by LC-QQQ spectrum analysis. As shown in FIG. 13A, the expression of SQS (SEQ ID NO: 11), SQE (SEQ ID NO: 39), SQE A4 (SEQ ID NO: 203), TTC (SEQ ID NO: 40), EPH (SEQ ID NO: 58), and the P450s SEQ ID NO: 194, SEQ ID NO: 197, and SEQ ID NO: 171 resulted in production of mogrol and oxo-mogrol. As shown in FIG. 13B and FIG. 13C, mogrol production was validated by LC-QQQ mass spectrum analysis using spiked authentic standard (FIG. 13B) and GC-FID chromatography versus an authentic standard (FIG. 13C), respectively.

Figure 14:
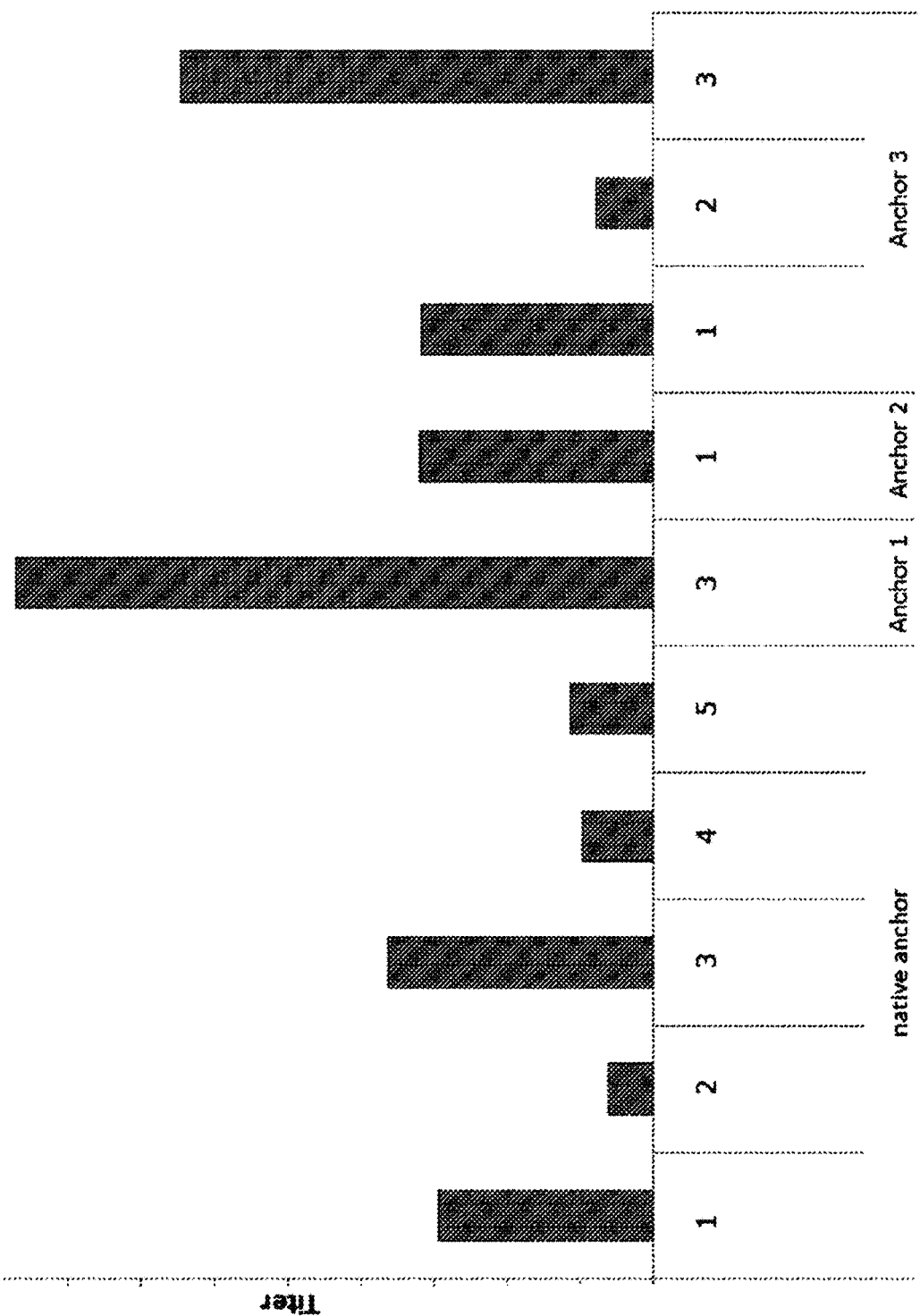
FIG. 14 shows the screening of cytochrome P450s for oxidation at C11 of the 24,25-dihydroxycucurbitadienol-like molecule cucurbitadienol. Native anchor P450 enzymes shown are: (1) SEQ ID NO: 194, (2) SEQ ID NO: 197, (3) SEQ ID NO: 171, (4) SEQ ID NO: 74, and (5) SEQ ID NO: SEQ ID NO: 75. In some cases, the native transmembrane domain was replaced with the transmembrane domain from *E. coli* sohB (Anchor 3). *E. coli* zipA (Anchor 2), or bovine 17a (Anchor 1) to improve interaction with the *E. coli* membrane. Each P450 was coexpressed with either CPR SEQ ID NO: 98 or CPR (SEQ ID NO: 201), resulting in production of 11-hydroxycucurbitadienol. These fermentation experiments were performed at 30° C. for 72 hours in 96 well plates.
Figure 15:
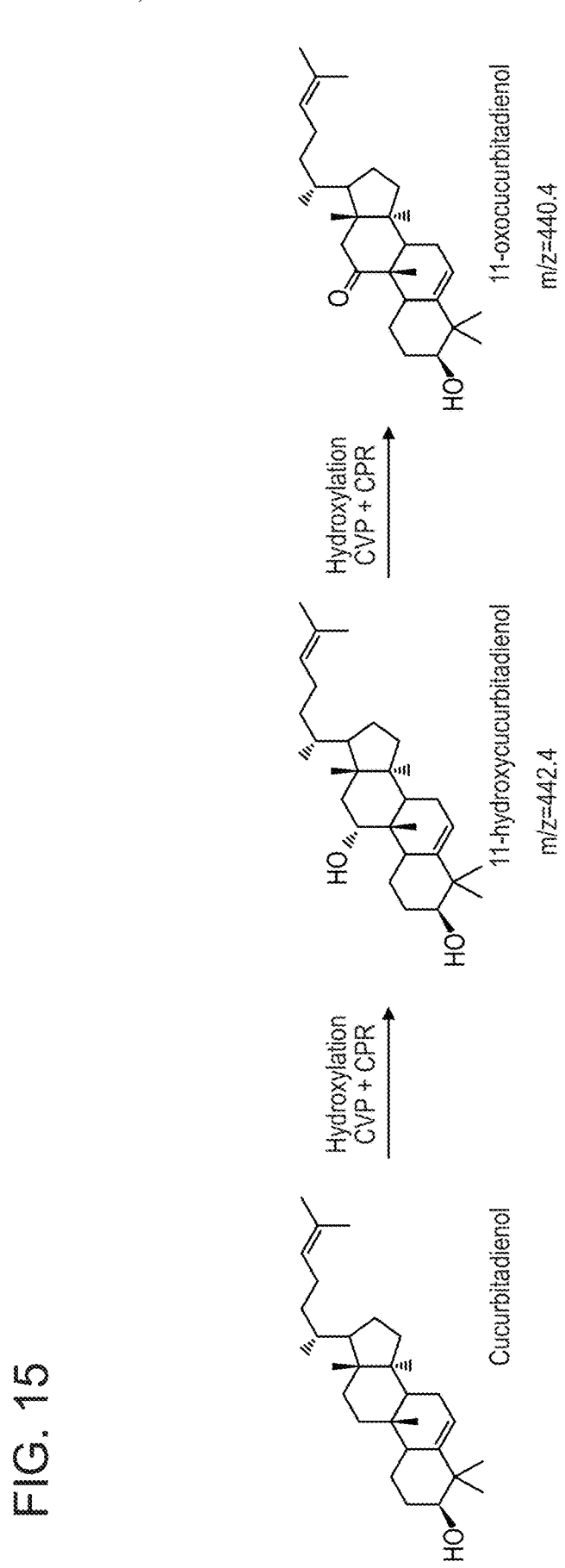
FIG. 15 shows production of products with oxidation at C11.
Figure 15:
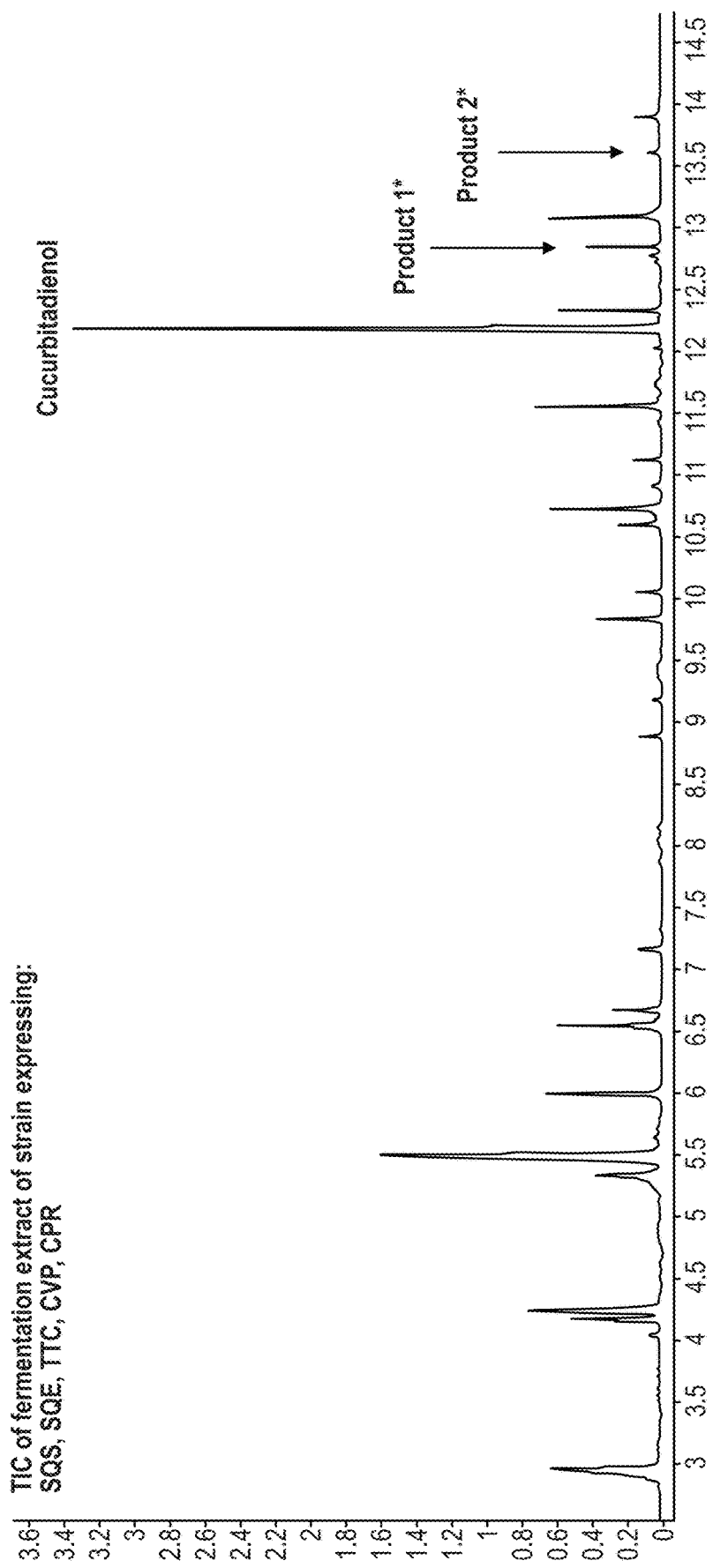
Figure 15:
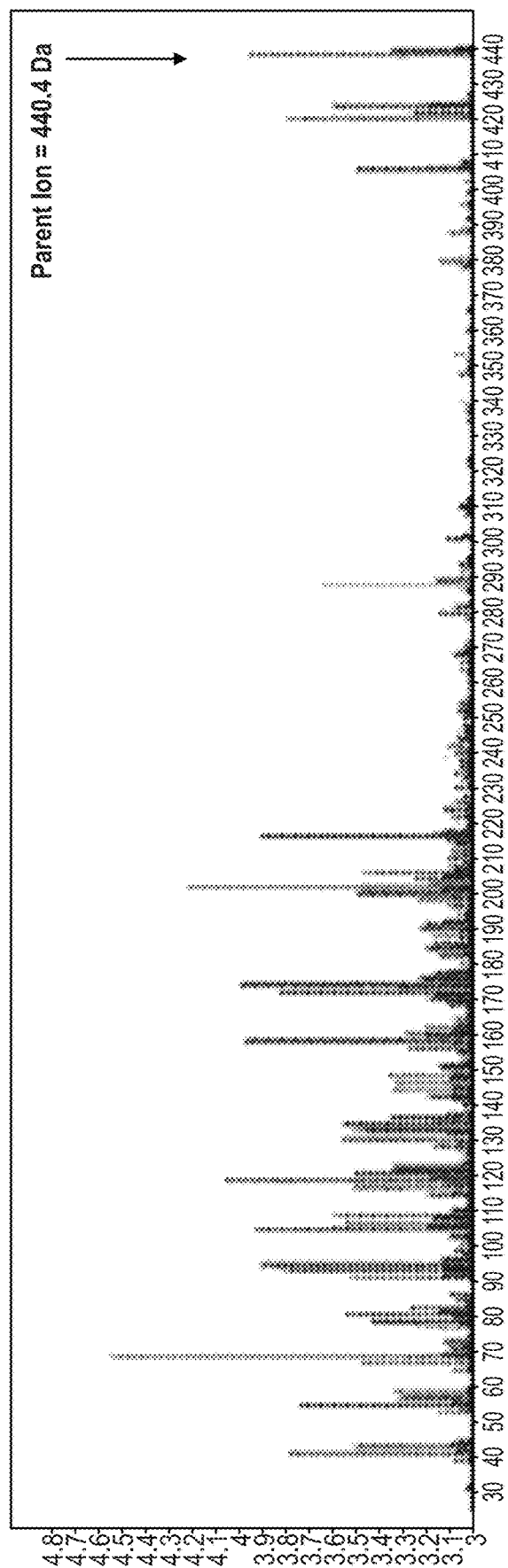

FIG. 14 shows the screening of cytochrome P450s for oxidation at C11 of the 24,25-dihydroxycucurbitadienol-like molecule cucurbitadienol. In many cases, the native transmembrane domain was replaced with the transmembrane domain from *E. coli* sohB (SEQ ID NO: 195, SEQ ID NO: 198, and SEQ ID NO: 199), *E. coli* zipA (SEQ ID NO. 196), or bovine 17% (e.g. SEQ ID NO: 200) to improve interaction with the *E. coli* membrane. Each P450 was coexpressed with either SEQ ID NO: 201 or SEQ ID NO: 98, resulting in production of 11-hydroxycucurbitadienol. These fermentation experiments were performed at 30° C. for 72 hours in 96 well plates. 11-hydroxy-cucurbitadienol production was verified by GC-MS. Concentrations were plotted for strains producing 11-hydroxycucurbitadienol. As shown in FIGS. 14 and 15, the strains disclosed herein were capable of production of 11-hydroxy-cucurbitadienol.

Figure 16A:
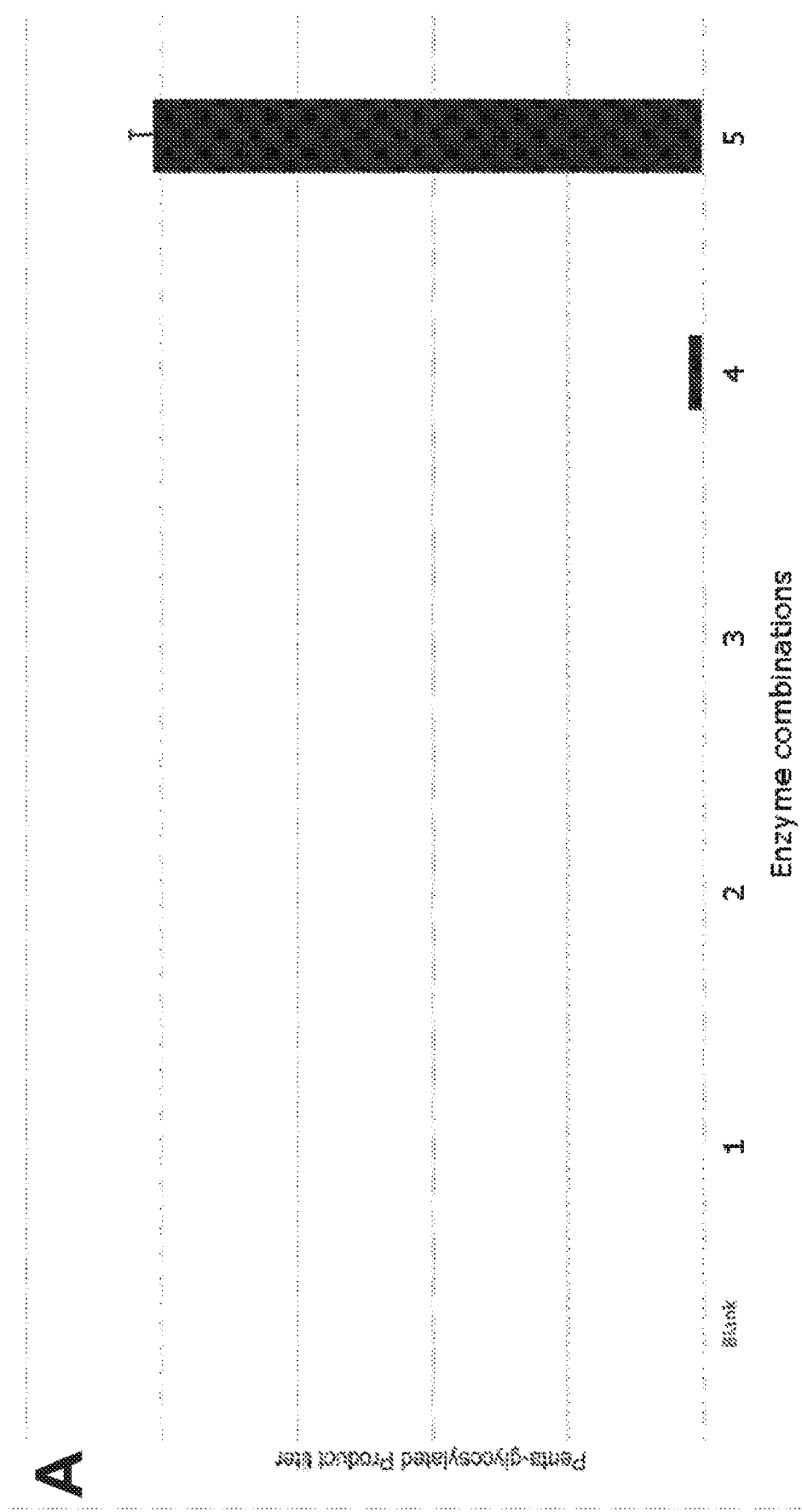
FIG. 16 shows Mog.V production using a combination of different enzymes. (A) Penta-glycosylated products are observed when UGTs of SEQ ID NO: 165, SEQ ID NO. 146, SEQ ID NO: 117, or SEQ ID NO: 164 are incubated together with mogrol as a substrate. Strains: (1) expresses SEQ ID NO: 165, (2) expresses SEQ ID NO: 146, (3) co-expresses SEQ ID NO: 165 and SEQ ID NO: 146, (4) co-expresses SEQ ID NO: 165, SEQ ID NO: 146, and SEQ ID NO: 117, (5) co-expresses SEQ ID NO. 165, SEQ ID NO. 146, SEQ ID NO. 117, and SEQ ID NO: 164. Mogroside substrates were incubated in Tris buffer containing magnesium chloride, beta-mercaptoethanol, UDP-glucose, single UGT, and a phosphatase. (B) Extracted ion chromatogram (EIC) for 1285.4 Da (mogroside V+H) of reactions containing SEQ ID NO: 165 and SEQ ID NO: 146, and either Enzyme 1 (SEQ ID NO: 117) or Enzyme 2 (SEQ ID NO: 164) when incubated with Mog.II-E. (C) Extracted ion chromatogram (EIC) for 1285.4 Da (mogroside V+H) of reactions containing SEQ ID NO: 165 and SEQ ID NO: 146 and either Enzyme 1 (SEQ ID NO: 117) or Enzyme 2 (SEQ ID NO: 164) when incubated with mogrol. Abbreviation: MogV, mogroside V.
Figure 16:
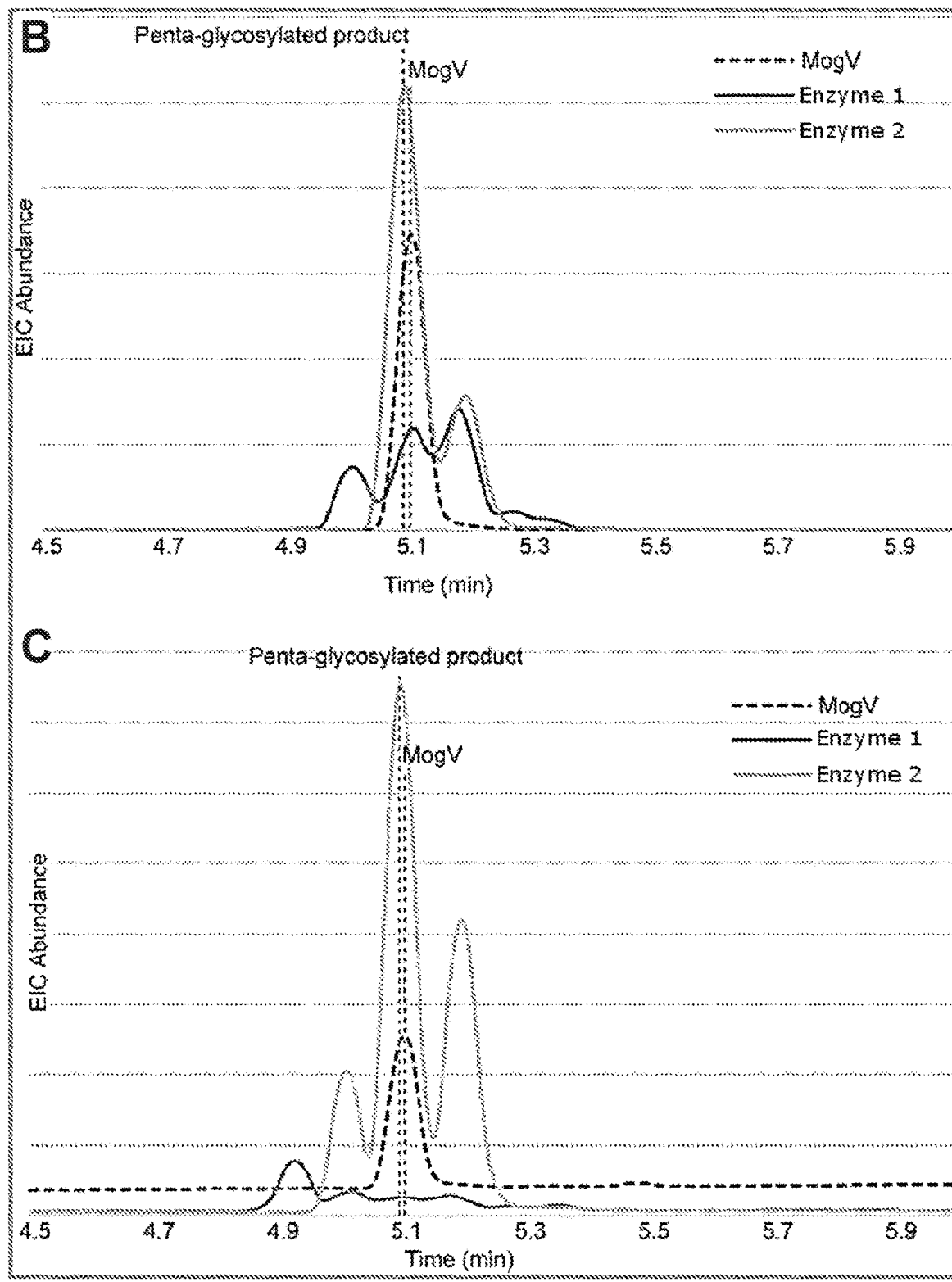

Mogrol was used as a substrate for in vitro glucosylation reactions with candidate UGT enzymes, to identify candidate enzymes that provide efficient glucosylation of mogrol to Mog.V. Reactions were carried out in 50 mM Tris-HCl buffer (pH 7.0) containing beta-mercaptoethanol (5 mM), magnesium chloride (400 uM), substrate (200 uM), UDP-glucose (5 mM), and a phosphatase (1 U). Results are shown in FIG. 16A. Mog.V product is observed when the UGT enzymes of SEQ ID NO: 165, SEQ ID NO: 146, and SEQ ID NO: 117 are incubated together. A penta-glycosylated product is formed when the UGT enzymes of SEQ ID NO: 165, SEQ ID NO: 146, and SEQ ID NO: 164) are incubated together. FIG. 16B, Extracted ion chromatogram (EIC) for 1285.4 Da (mogroside V+H) of reactions containing enzymes of SEQ ID NO: 165+SEQ ID NO 146 and either SEQ ID NO: 117 (solid dark grey line) or SEQ ID NO: 164 (light grey line) when incubated with Mog.II-E. FIG. 16C, Extracted ion chromatogram (EIC) for 1285.4 Da (mogroside V+H) of reactions containing enzymes of SEQ ID NO: 165+SEQ ID NO: 146 and either SEQ ID NO: 117 (solid dark grey line) or SEQ ID NO: 164 (light grey line) when incubated with mogrol.

Figure 17:
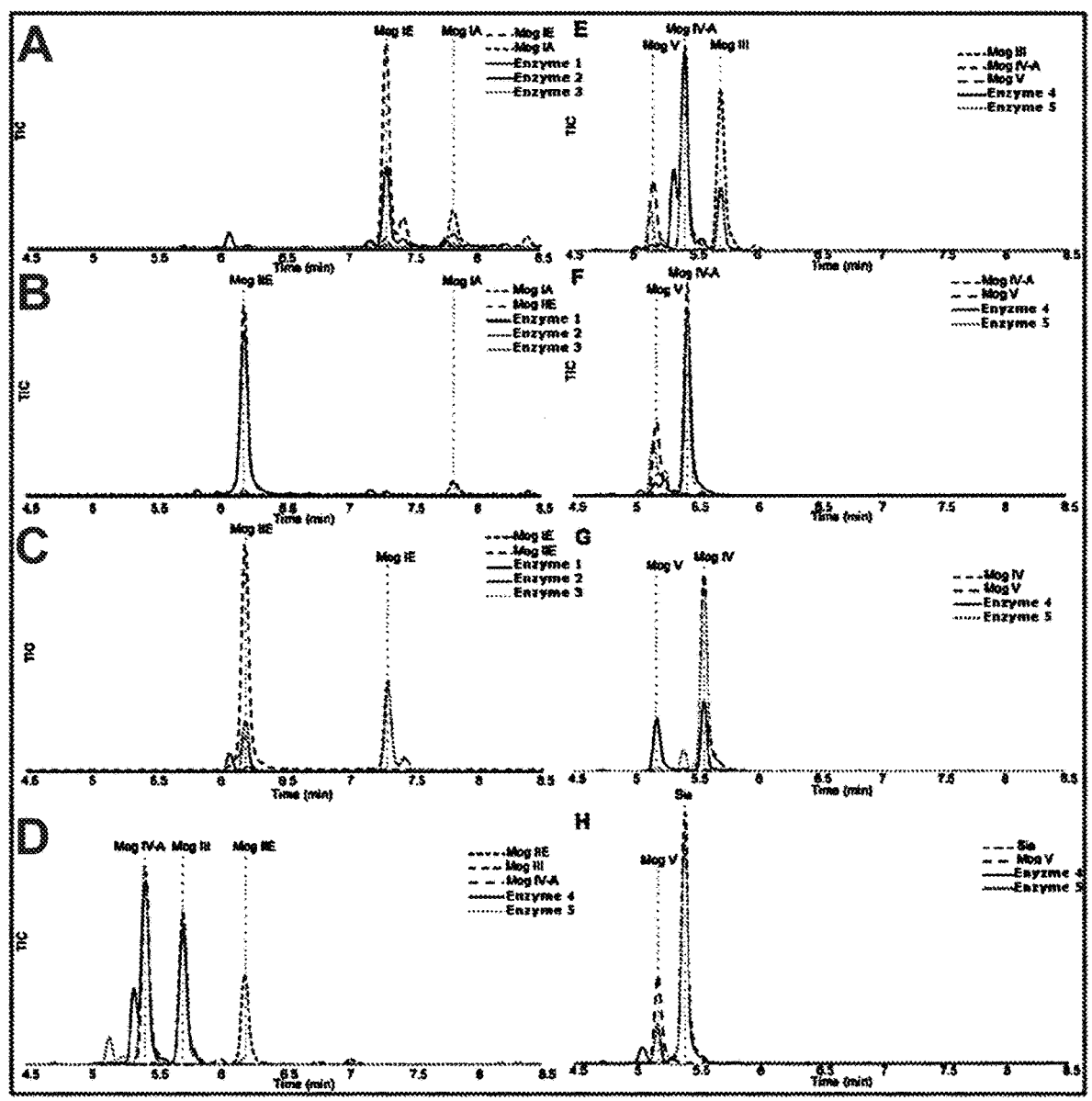
FIG. 17 shows in vitro assays showing the conversion of mogroside substrates to more glycosylated products. Mogroside substrates were incubated in Tris buffer containing magnesium chloride, beta-mercaptoethanol, UDP-glucose, single UGT, and a phosphatase. The panels correspond to the use of different substrates: (A) mogrol; (B) Mog.I-A; (C) Mog.I-E; (D) Mog.II-E; (E) Mog.III; (F) Mog.IV-A; (G) Mog.IV; (H) siamenoside. Enzyme 1 (SEQ ID NO: 165), Enzyme 2 (SEQ ID NO: 146), Enzyme 3 (SEQ ID NO: 116), Enzyme 4 (SEQ ID NO: 117), and Enzyme 5 (SEQ ID NO: 164).

FIG. 4 and FIG. 17 show additional glycosyltransferase activities observed on particular substrates Coexpression of UGT enzymes can be selected to move product to the desired mogroside product.

Figure 18:
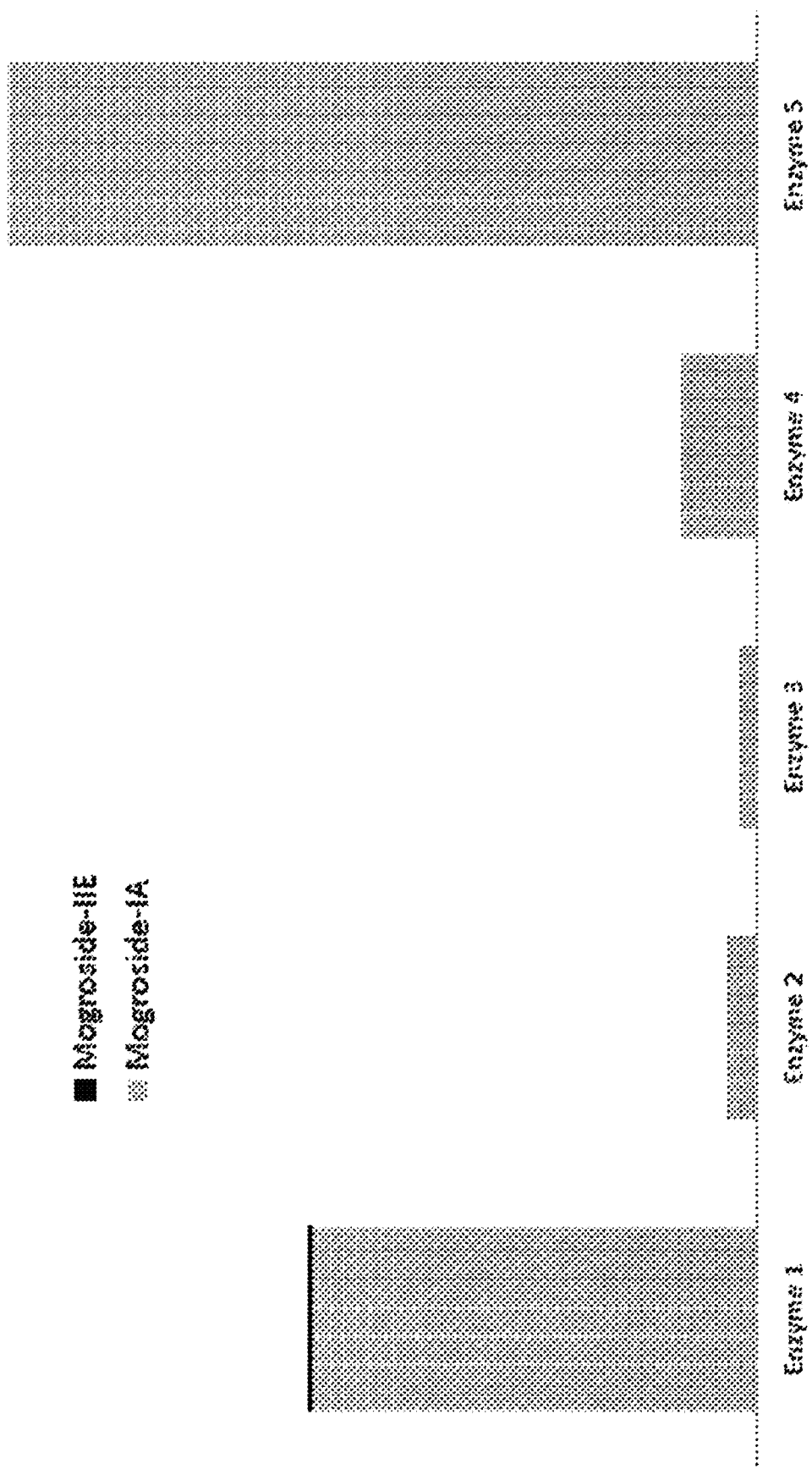
FIG. 18 shows the bioconversion of mogrol into mogroside-IA or mogroside-IIE. In the experiment, engineered *E. coli* strains were inoculated with 0.2 mM mogrol at 37° C. Product formation was examined after 48 hours. The values are reported relative to the empty vector control (the values reported are the detected compound minus the background level detected in the empty vector control). Products were measured on LC/MS-QQQ with authentic standards. Only Enzyme 1 shows formation of mogroside-HE. Enzyme 1 to 5 are SEQ ID NOS: 202, 116, 216, 217, and 218 respectively.

FIG. 18 shows the bioconversion of mogrol into mogroside intermediates. Engineered *E. coli* strains (see US 2020/0087692, which is hereby incorporated by reference in its entirety) expressing UGT enzymes were incubated in 96-well plates with 0.2 mM mogrol. Product formation was examined after 48 hours. Reported values are those in excess of the empty vector control. Products were measured on LC-MS/MS with authentic standards. Only Enzyme 1 shows formation of Mog.IIE. Enzymes 1 to 5 are SEQ ID NOS: 202, 116, 216, 217, and 218, respectively.

Figure 19:
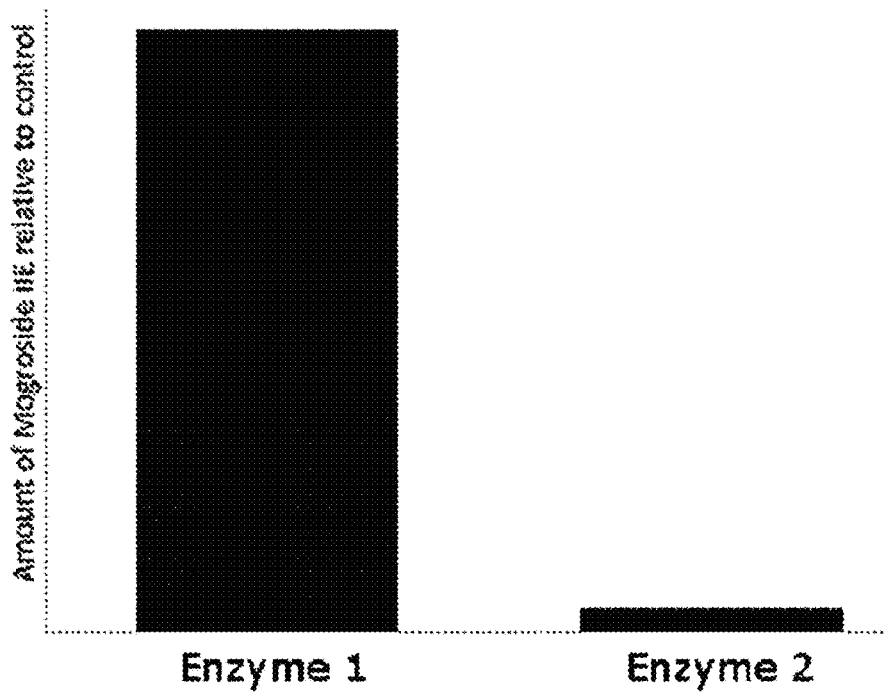
FIG. 19A and FIG. 19B shows the bioconversion of Mog.IA (FIG. 19A) or Mog.IE (FIG. 18B) into Mog.IIE. Engineered *E. coli* strains (expressing either Enzyme 1, SEQ ID NO: 165; Enzyme 2, SEQ ID NO: 202; or Enzyme 3, SEQ ID NO: 116) were grown at 37° C. in fermentation media containing 0.2 mM Mog.IA (FIG. 19A) or Mog.IE (FIG. 19B). Product formation was measured after 48 hours using LC-MS/MS with authentic standards. Reported values are those in excess of the empty vector control.
Figure 19:
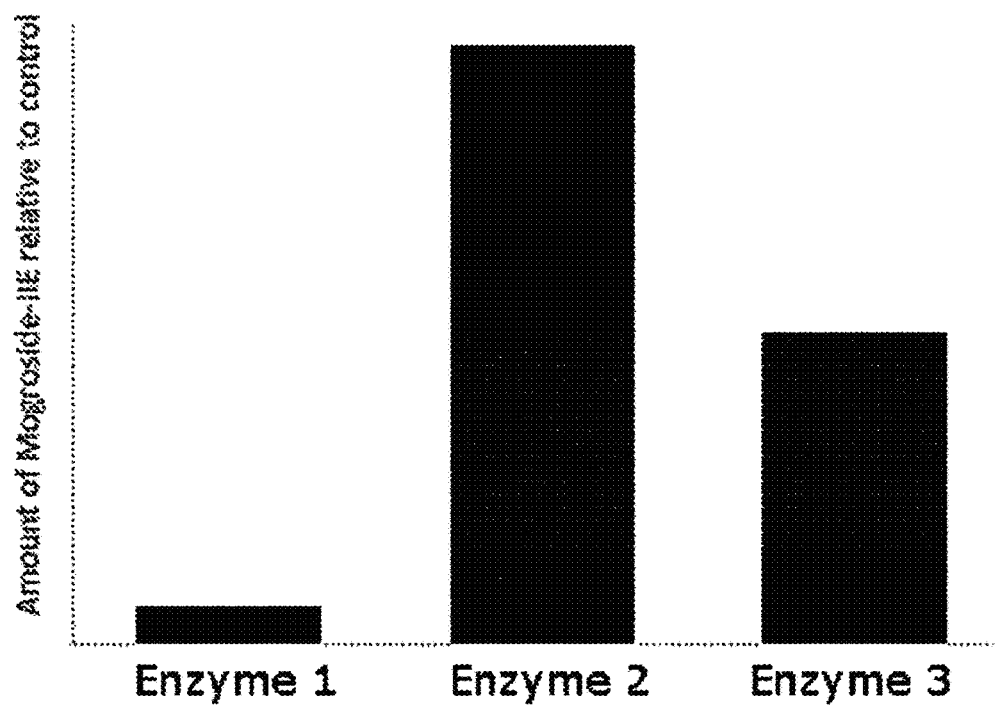

FIG. 19A and FIG. 19B shows the bioconversion of Mog.IA (FIG. 19A) or Mog.IE (FIG. 19B) into Mog IIE. In the experiment, engineered E. coli strains (as above) expressing UGT enzymes, SEQ ID NO: 165, SEQ ID NO: 202, or SEQ ID NO: 116 were incubated in fermentation media containing 0.2 mM Mog.IA (FIG. 19A) or Mog.IE (FIG. 19B) in 96-well plates at 37° C. Product formation was examined after 48 hours. Products were measured on LC-MS/MS with authentic standards. The values of Mog.IIE levels in excess of the empty vector control were calculated. As shown in FIG. 19A, SEQ ID NO: 165 and SEQ ID NO: 202 were able to catalyze bioconversion of Mog.IA into Mog.IIE. Similarly, as shown in FIG. 19B, SEQ ID NO: 165, SEQ ID NO: 202, and SEQ ID NO: 116 were able to catalyze the bioconversion of Mog.IE into Mog.IIE.

Figure 20:
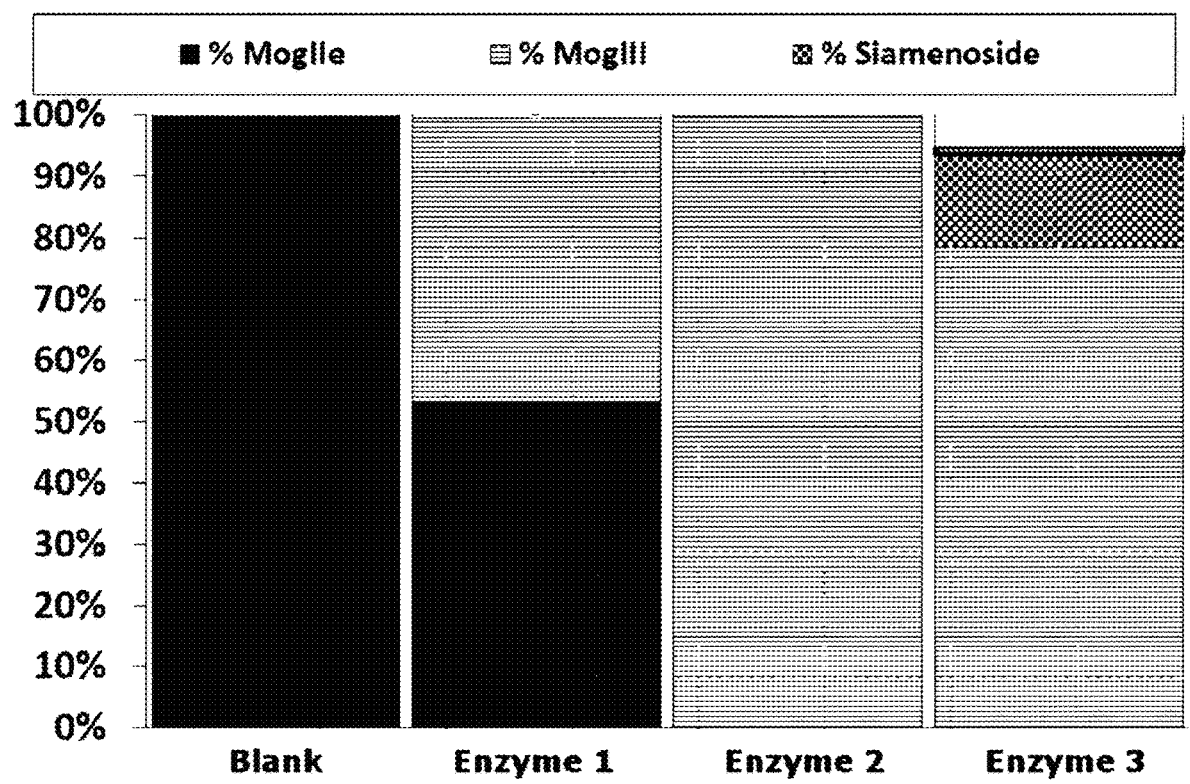
FIG. 20 shows the production of Mog.III or siamenoside from Mog.II-E by engineered *E. coli* strains expressing Enzyme 1 (SEQ ID NO: 204), Enzyme 2 (SEQ ID NO: 138), or Enzyme 3 (SEQ ID NO: 206). Strains were grown at 37° C. in fermentation media containing 0.2 mM Mog.IA, and product formation was measured after 48 hours using LC-MS/MS with authentic standards.

FIG. 20 shows the production of Mog.II or siamenoside from Mog.II-E. In the experiment, engineered E. coli strains expressing UGT enzymes SEQ ID NO: 204, SEQ ID NO: 138 or SEQ ID NO: 206 were grown in fermentation media containing 0.1 mM Mog.II-E at 37° C. for 48 hr. Products were quantified by LCMS/MS with authentic standards of each compound. As shown in FIG. 20, all strains were able to catalyze bioconversion of Mog.IIE to Mog.III. In addition, MbUGT1,2.2 also showed production of substantial amounts of siamenoside.

Figure 21:
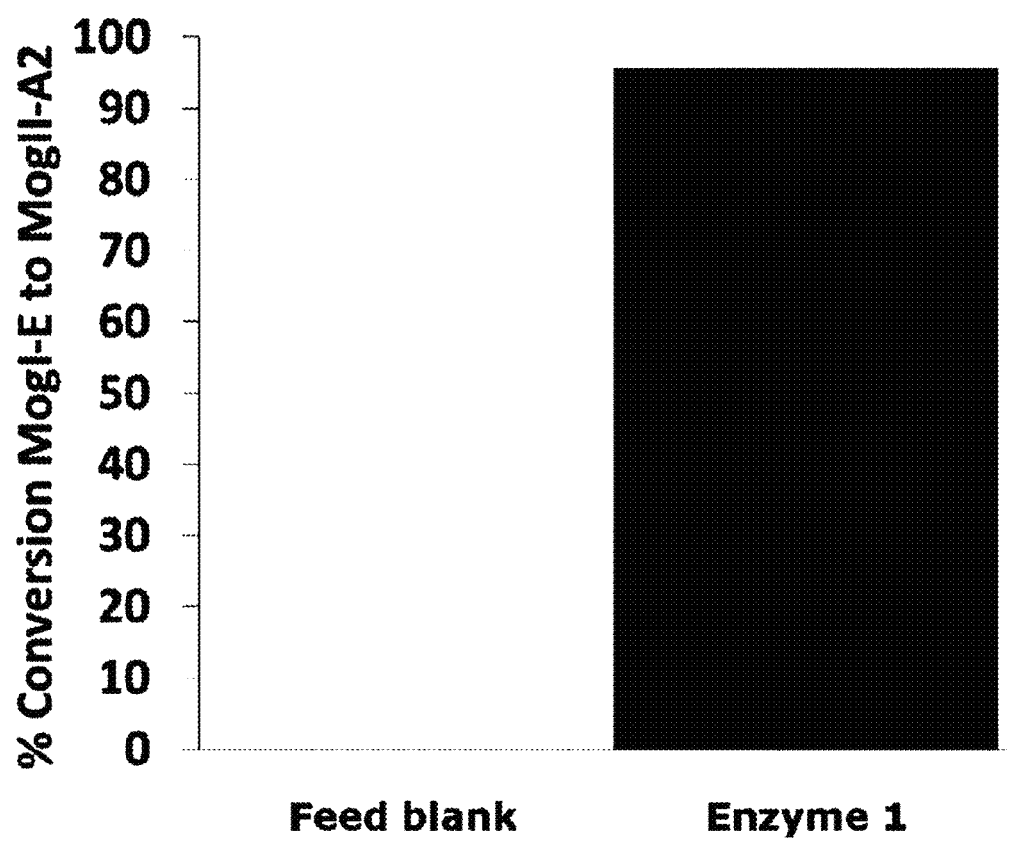
FIG. 21 shows the in vitro production of Mog.IIA2 by cells expressing Enzyme 1 (SEQ ID NO: 205). 0.1 mM Mog.I-E was added, and reactions were incubated at 37° C. for 48 hr. Data was quantified by LC MS/MS with authentic standards of each compound.

FIG. 21 shows the production of Mog.II-A2. 0.1 mM Mog.I-E was fed in vitro. In the experiment, engineered E. coli strains expressing UGT enzyme SEQ ID NO: 205 were incubated at 37° C. for 48 hr. Products were quantified by LC-MS/MS with authentic standards of each compound. As shown in FIG. 21, SEQ ID NO: 205 is able to catalyze bioconversion of Mog.IE to Mog.II-A2.

A summary of observed primary glycosylation reactions at C3 and C24 hydroxyls of mogrol are provided in Table 1. Specifically, 0.2 mM mogrol was fed to cells expressing various UGT enzymes. Reactions were incubated at 37° C. for 48 hrs. Products were quantified by LCMS/MS with authentic standards of each compound.

TABLE 1

| UGT | C3 O-Glucosylation | C24 O-Glucosylation |
|---|---|---|
| SEQ ID NO: 165 | Yes | Yes |
| SEQ ID NO: 146 | No | Yes |
| SEQ ID NO: 214 | No | Yes |
| SEQ ID NO: 202 | Yes | Yes |
| SEQ ID NO: 129 | Yes | No |
| SEQ ID NO: 116 | Yes | Yes |
| SEQ ID NO: 218 | No | Yes |
| SEQ ID NO: 216 | No | Yes |
| SEQ ID NO: 217 | No | Yes |

A summary of branched glycosylation reactions are provided in Table 2. 0.2 mM Mog.IIE or Mog.IE was fed to cells expressing various UGT enzymes. Reactions were incubated at 37° C. for 48 hr. Products were quantified by LC-MS/MS with authentic standards of each compound. "Indirect" evidence means that consumption of substrate was observed.

TABLE 2

| Name | C3 1-2 | C3 1-6 | C24 1-2 | C24 1-6 |
|---|---|---|---|---|
| SEQ ID NO: 205 | No | Yes | No | Yes |
| SEQ ID NO: 204 | No | Yes | No | No |
| SEQ ID NO: 122 | No | Yes | Yes | Yes |
| SEQ ID NO: 211 | No | No | Yes | No |
| SEQ ID NO: 138 | No | Yes | No | Yes |
| SEQ ID NO: 207 | No | Yes | No | Yes |
| SEQ ID NO: 209 | No | Yes | No | Yes |
| SEQ ID NO: 208 | Yes (Indirect) | Yes | Yes (Indirect) | Yes (Indirect) |
| SEQ ID NO: 206 | Yes (Indirect) | Yes | Yes (Indirect) | Yes |
| SEQ ID NO: 164 | No | Yes | Yes | Yes |
| SEQ ID NO: 210 | No | Yes | No | Yes |
| SEQ ID NO: 215 | No | No | No | Yes |
| SEQ ID NO: 213 | No | No | No | Yes |

Figure 22:
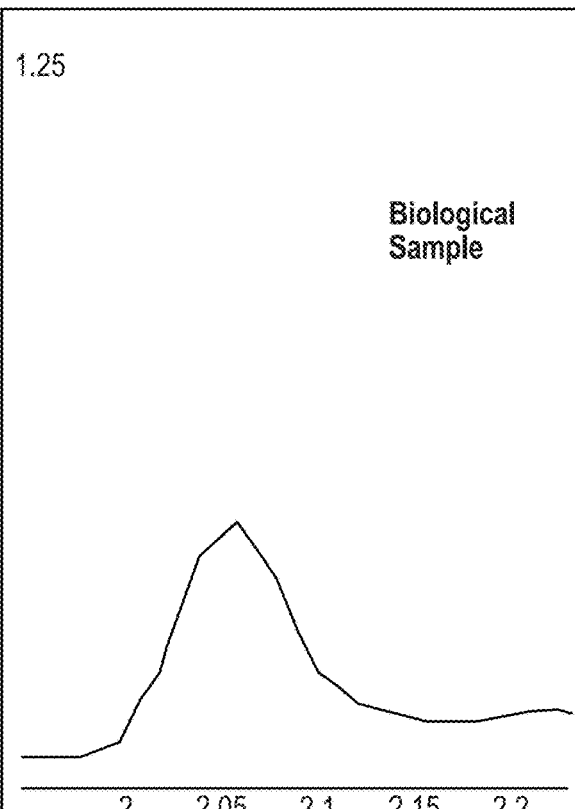
FIG. 22(A,B) shows production of Mog.V in *E. coli*. (A) Chromatogram indicating Mog.V production from engineered *E. coli* strains expressing SEQ ID NO: 11, SEQ ID NO: 39, SEQ ID NO: 203, SEQ ID NO: 40, SEQ ID NO: 189, SEQ ID NO: 199, SEQ ID NO: 202, SEQ ID NO: 165, and SEQ ID NO: 122. Strains were incubated at 30° C. for 72 hours before extraction. Mog.V production was verified by LC-QQQ spectrum analysis versus an authentic standard. (B) Chromatogram indicating Mog.V production from a biological sample with a spiked Mog.V authentic standard.
Figure 22:
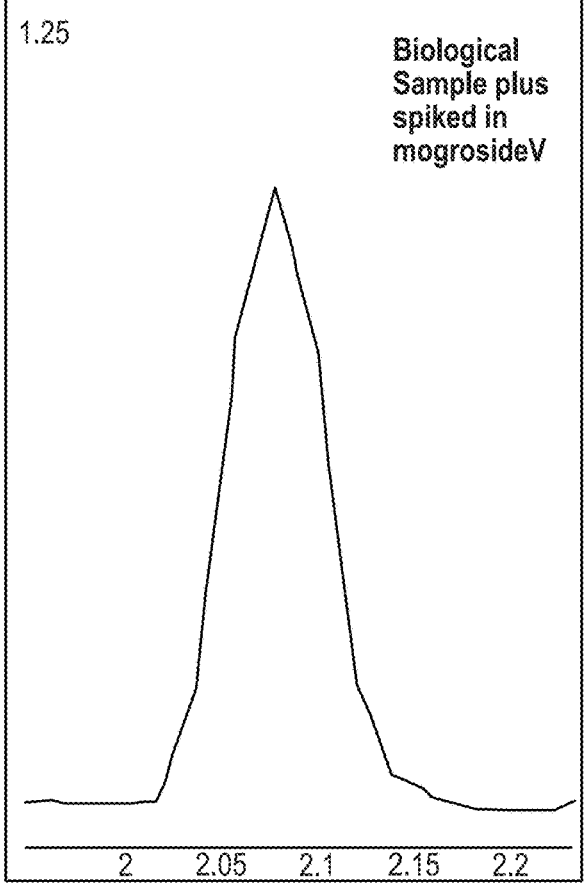

An exemplary E. coli strain producing Mog.V was created by expressing the following enzymes in an K E. coli strain engineered to produce high levels of MEP pathway products: SQS (SEQ ID NO: 11), SQE (SEQ ID NO: 39), SQE A4 (SEQ ID NO: 203), TTC (SEQ ID NO: 40), EPH (SEQ ID NO: 189), sohB_CppCYP (SEQ ID NO: 199), AtUGT73C3 (SEQ ID NO: 202), UGT85C1 (SEQ ID NO: 165), and UGT94-289-1 (SEQ ID NO: 122). Production of Mog.V is demonstrated in FIG. 22A, B. Strains were incubated at 30° C. for 72 hours before extraction. Mog.V production was verified by LC-QQQ spectrum analysis versus an authentic standard FIG. 22A. FIG. 22B shows a chromatogram indicating Mog.V production from a biological sample with a spiked Mog.V authentic standard.

Biosynthesis enzymes can be further engineered for expression and activity in microbial cells, using known structures and primary sequences.

FIG. 26 is an amino acid alignment of CaUGT_1,6 and SgUGT94_289_3 using Clustal Omega (Version CLUSTAL O (1,2,4). These sequences share 54% amino acid identity. Coffea arabica UGT_1,6 is predicted to be a beta-D-glucosyl crocetin beta 1,6-glucosyltransferase-like (XP_027096357.1). Together with known UGT structures and primary sequences, CaUGT_1,6 can be further engineered for microbial expression and activity, including engineering of a circular permutant.

FIG. 27 is an amino acid alignment of Homo sapiens squalene synthase (HsSQS) (NCBI accession NP_004453.3) and AaSQS (SEQ ID NO: 11) using Clustal Omega (Version CLUSTAL O (1.2.4)). HsSQS has a published crystal structure (PDB entry: 1EZF). These sequences share 42% amino acid identity.

FIG. 28 is an amino acid alignment of Homo sapiens squalene epoxidase (HsSQE) (NCBI accession XP_011515548) and MlSQE (SEQ ID NO: 39) using Clustal Omega (Version CLUSTAL O (1.2.4)). HsSQE has a published crystal structure (PDB entry: 6C6N). These sequences share 35% amino acid identity.

The UGT enzyme of SEQ ID NO: 164 was engineered for improved glycosylation activity. Various amino acid substitutions were made to the enzyme, as informed by in silico analysis. The following amino acid substitutions in Table 3 were tested for further glycosylation of mog.IIE.

TABLE 3

| Substitution | Fold Improvement in UDP-Glucose Transferred |
|---|---|
| G150F | 13.2 |
| T147L | 13.0 |

TABLE 3-continued

| Substitution | Fold Improvment in UDP-Glucose Transferred |
|---|---|
| N207K | 10.9 |
| K270E | 10.0 |
| V281L | 9.1 |
| L354V | 8.6 |
| L13F | 7.5 |
| T32A | 5.6 |
| K101A | 5.3 |
| C219E | 4.9 |
| V281Q | 4.6 |
| S43T | 4.6 |
| M394V | 4.6 |
| E74G | 4.5 |
| K270P | 4.1 |
| T256V | 3.9 |
| V175K | 3.9 |
| N283G | 3.4 |
| D285P | 3.3 |
| A377V | 3.2 |
| F217L | 3.1 |
| K204R | 3.1 |
| T303A | 3.0 |
| D95K | 2.9 |
| S14 II | 2.7 |
| K270T | 2.7 |
| V281A | 2.5 |
| A166 del. | 2.2 |
| G205S | 2.1 |
| N333S | 2.0 |
| K270M | 2.0 |
| F132L | 2.0 |
| L40F | 1.9 |
| A166K | 1.9 |
| V281K | 1.8 |
| R185S | 1.7 |
| F8L | 1.7 |
| F258Y | 1.7 |
| N35G | 1.7 |
| N133G | 1.7 |
| A77P | 1.6 |
| N207Y | 1.6 |
| K386D | 1.6 |
| Y163F | 1.5 |
| N399R | 1.5 |
| H18Y | 1.5 |
| A166S | 1.3 |
| K101E | 1.3 |
| Q418K | 1.3 |
| I191V | 1.3 |
| R182S | 1.2 |
| K101Q | 1.2 |
| S142F | 1.2 |
| T46N | 1.2 |
| T159E | 1.2 |
| T55P | 1.2 |
| K160D | 1.2 |
| T7K | 1.2 |
| A166T | 1.1 |

Figure 23:
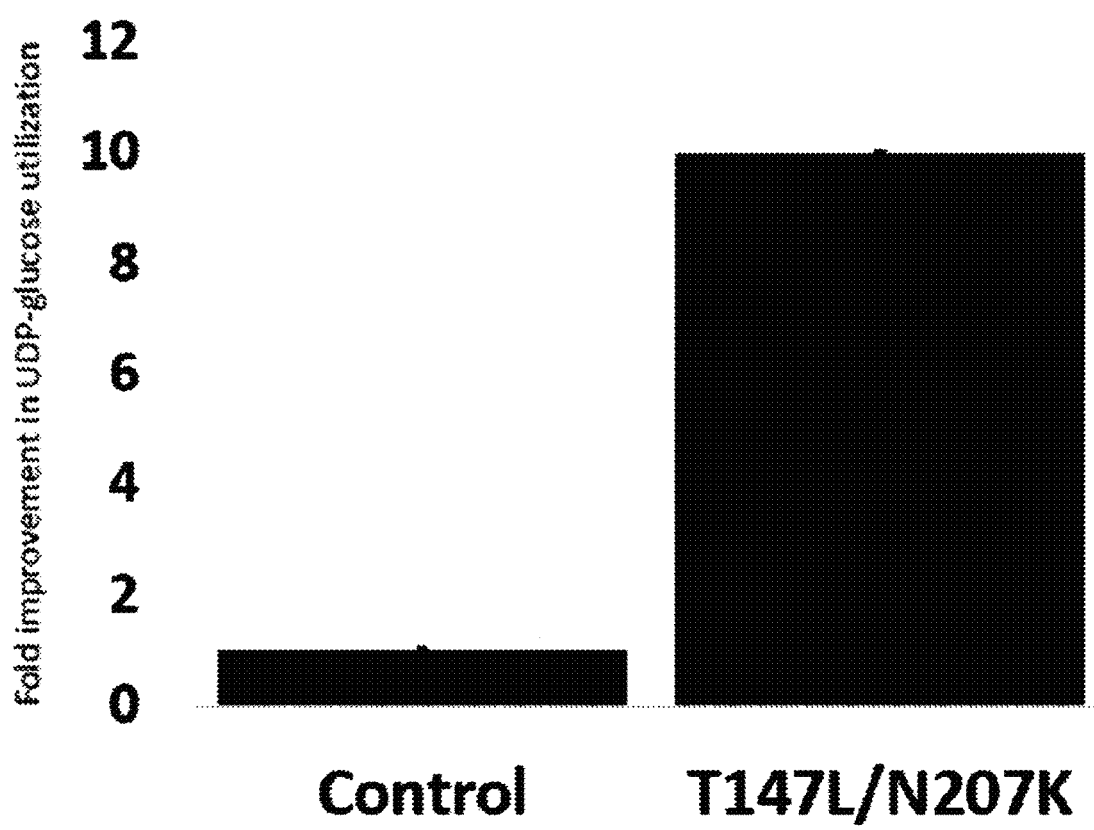
FIG. 23 shows bioconversion of mogroside-HE to further glycosylated products using an engineered version of the UGT enzyme of SEQ ID NO. 164.

An engineered UGT enzyme based on SEQ ID NO: 164 was prepared having substitutions T147L and N207K. The bioconversion of Mog.IIE to further glycosylated products is shown in FIG. 23. In the experiment, engineered *E. coli* strains expressing the engineered CaUGT_1,6 were inoculated with Mog.IIE substrate at 37° C. Product formation was examined after 48 hours. Products were measured on LC/MS-QQQ with authentic standards.

The UGT enzyme of SEQ ID NO: 165 was engineered for improved glycosylation activity. The following amino acid substitutions were identified as improving bioconversion of Mog.IA to Mog.IIE (Table 4):

TABLE 4

| Substitution | Fold Improvement in Mog.IA to Mog.IIE Bioconversion |
|---|---|
| CTL | 1 |
| L41F | 1.29 |
| D49E | 1.36 |
| C127F | 1.48 |

Figure 24:
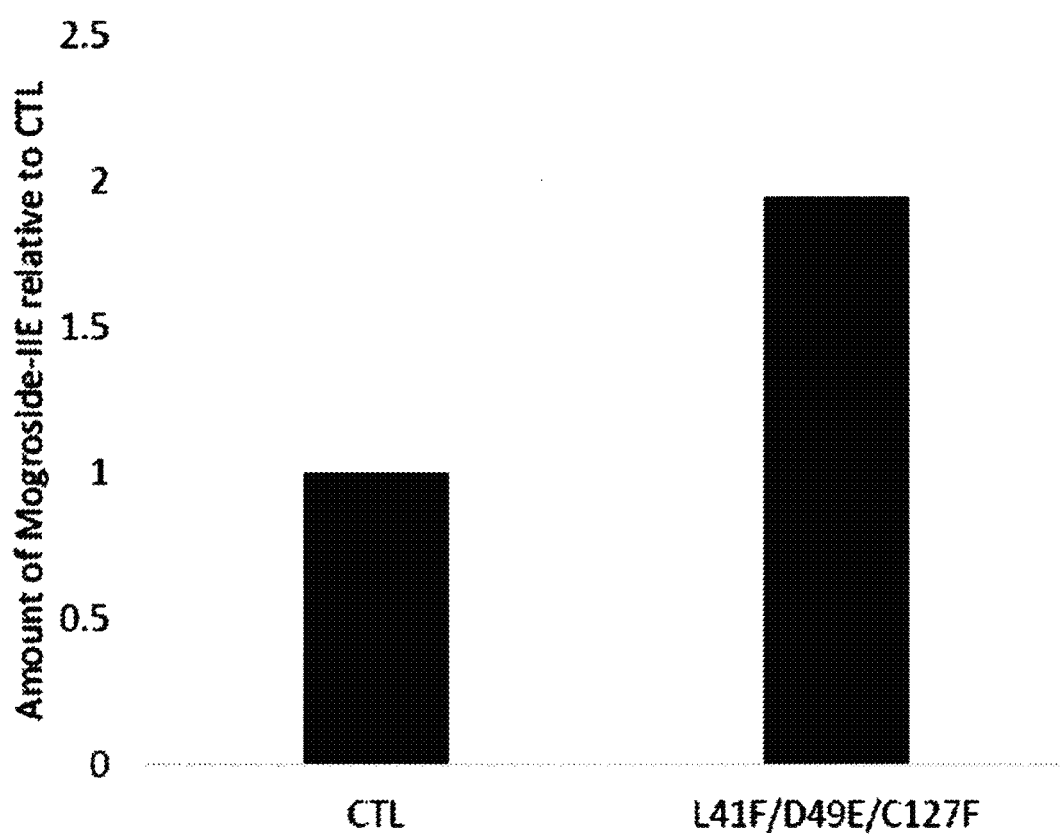
FIG. 24 shows bioconversion of Mog.IA to Mog.IE with an engineered version of the UGT enzyme of SEQ ID NO: 165.

An engineered UGT enzyme based on 85C1 was prepared having substitutions L41F, D49E, and C127F. The bioconversion of Mog.IA to Mog.IIE is shown in FIG. 24. In the experiment, engineered *E. coli* strains expressing the engineered 85C11 were inoculated with Mog.IA substrate at 37° C. Product formation was examined after 48 hours. Products were measured on LC/MS-QQQ with authentic standards. FIG. 24 shows the fold improvement of the engineered version compared to the control (85C1).

The UGT enzyme of SEQ ID NO: 217 (UGT73F24) was engineered for improved glycosylation activity. The following amino acid substitutions were identified as improving bioconversion of Mog.IE to Mog.IIE with UGT73F24 (Table 5):

TABLE 5

| Substitution | Fold Improvement in Mog.IE to Mog.IIE Production |
|---|---|
| CTL | 1 |
| A74E | 1.88 |
| I191F | 2,01 |
| H101P | 2.38 |
| Q241E | 1.31 |
| I436L | 1.09 |

Figure 25:
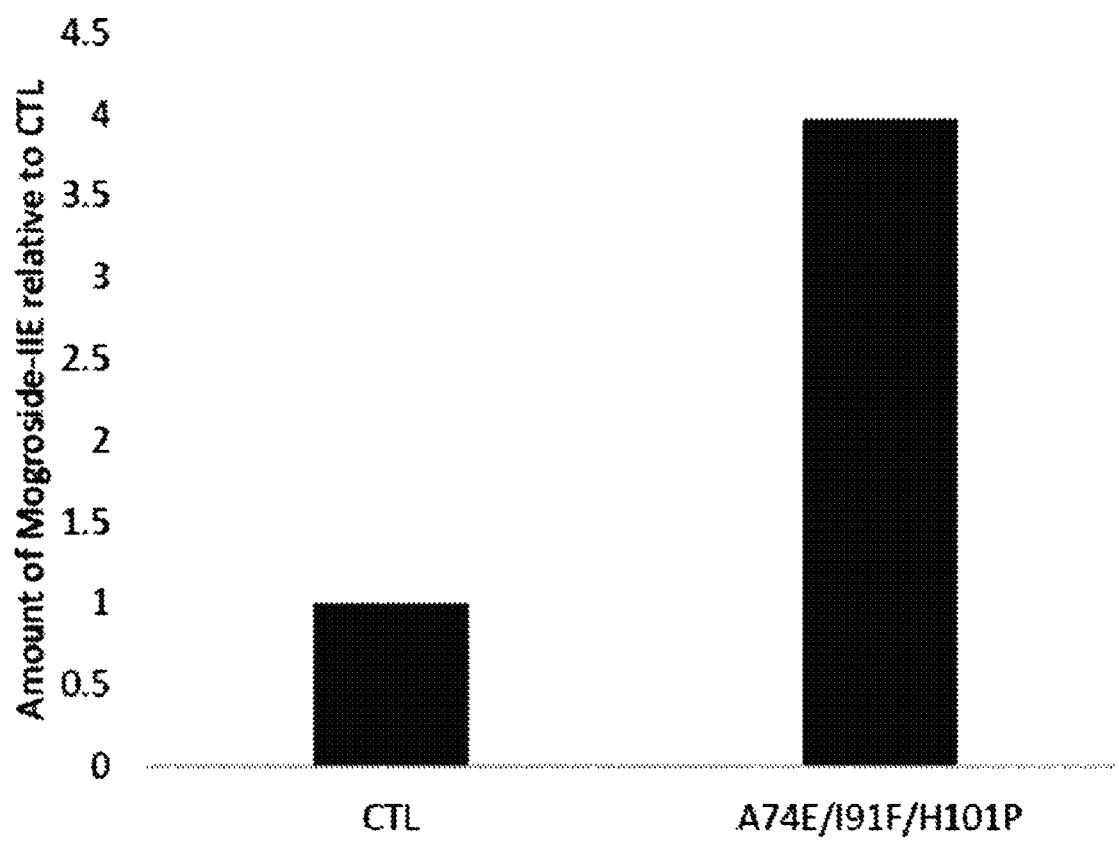
FIG. 25 shows bioconversion of Mog.IE to Mog.IIE with an engineered version of the UGT enzyme of SEQ ID NO: 217.

An engineered UGT enzyme based on UGT73F24 was prepared having substitutions A74E, I9F, and H101P. The bioconversion of Mog.IE to Mog.IIE is shown in FIG. 25. In the experiment, engineered *E. coli* strains expressing the engineered UGT73F24 were inoculated with Mog.IE substrate at 37° C. Product formation was examined after 48 hours. Products were measured on LC/MS-QQQ with authentic standards. FIG. 25 shows the fold improvement of the engineered version compared to the control (73F24).

```
SEQUENCES
Farnesyl Pyrophosphate Synthase (FPPS)
Saccharomyces cerevisiae FPPS
                                                    (SEQ ID NO: 1)
MASEKEIRRERFLNVFPKLVEELNASLLAYGMPKEACDWYAHSLNYNTPGGKLNRCLSVVDTYA

ILSNKTVEQLGQEEYEKVAILGWCIELLQAYFLVADDMMDKSITRRGQPCWYKVPEVGEIAIND

AFMLEAAIYKLLKSHFRNEKYYIDITELFHEVTFQTELGQLMDLITAPEDKVDLSKFSLKKHSF

IVTFKTAYYSFYLPVALAMYVAGITDEKDLKQARDVLIPLGEYFQIQDDYLDCFGTPEQIGKIG

TDIQDNKCSWVINKALELASAEQRKTLDENYGKKDSVAEAKCKKIFNDLKIEQLYHEYEESIAK
```

-continued

DLKAKISQVDESRGFKADVLTAFLNKVYKRSK

Squalene Synthase (SQS)
*Siraitia grosvenorii* SQSa
(SEQ ID NO: 2)
MGSLGAILRHPDDFYPLLKLKMAARHAEKQIPPEPHWGFCYTMLHKVSRSFALVIQQLAPELRN

AICIFYLVLRALDTVEDDTSIQTDIKVPILKAFHCHIYNRDWHFSCGTKDYKVLMDQFHHVSTA

FLELGKGYQEATEDITKRMGAGMAKFICKEVETVDDYDEYCHYVAGLVGLGLSKLFHASDLEDL

APDSLSNSMGLLLQKTNIIRDYLEDINEIPKSRMFWPREIWGKYADKLEDFKYEENSVKAVQCI

NDLVTNALNHVEDCLKYMSNLRDLSIFRFCAIPQIMAIGTLALCYNNVEVFRGVVKMRRGLTAK

VIDRTQTMADVYGAFFDFSVMLKAKVNSSDPNATKTLSRIEAIQKTCEQSGLLNKRKLYAVKSE

PMFNPTLIVILFSLLCIILAYLSAKRIPANQPV

*Siraitia grosvenorii* SQSb
(SEQ ID NO: 3)
MGSLGAILRHPDDFYPLLKLKMAARHAEKQIPPEPHWGFCYTMLHKVSRSFALVIQQLAPELRN

AICIFYLVLRALDTVEDDTSIQTDIKVPILKAFHCHIYNRDWHFSCGTKDYKVLMDQFHHVSTA

FLELGKGYQEAIEDITKRMGAGMAKFICKEVETVDDYDEYCHYVAGLVGLGLSKLFHASDLEDL

APDSLSNSMGLLLQKTNIIRDYLEDINEIPKSRMFWPREIWGKYADKLEDFKYEENSVKAVQCL

NDLVTNALNHVEDCLKYMSNLRDLSIFRFCAIPQIMAIGTLALCYNNVEVFRGVVKMRRGLTAK

VIDRTQTMADVYGAFFDFSVMLKAKVNNSDPNATKTLSRIEAIQKTCEQSGLLNKRKLYAVKSE

PMFNPTLIVILFSLLCIILAYLSAKRLPANQPV

*Cucumis sativus*
(SEQ ID NO: 4)
MGSLGAILKHPDDFYPLLKLKIAARHAEKQIPPEPHWGFCYTMLHKVSRSFALVIQQLKPELRN

AVCIFYLVLRALDTVEDDTSIQTDIKVPILKAFHCHIYNRDWHFSCGTKDYKVLMDEFHHVSTA

FLELGKGYQEAIEDITKRMGAGMAKFICKEVETVDDYDEYCHYVAGLVGLGLSKLFHAAELEDL

APDSLSNSMGLFLQKTNIIRDYLEDINEIPKSRMFWPREIWGKYADKLEDFKYEENSVKAVQCL

NDLVTNALNHVEDCLKYMSNLRDLSIFRFCAIPQIMAIGTLALCYNNVEVFRGVVKMRRGLTAK

VIDRTKTMADVYGAFFDFSVMLKAKVNSNDPNASKTLSRIEAIQKTCKQSGILNRRKLYVVRSE

PMFNPAVIVILFSLLCIILAYLSAKRLPANQSV

*Cucumis melo*
(SEQ ID NO: 5)
MGSLGAILKHPDDFYPLLKLKMAARHAEKQIPPESHWGFCYTMLHKVSRSFALVIQQLKPELRN

AVCIFYLVLRALDTVEDDTSIQTDIKVPILKAFHCHIYNRDWHFSCGTKDYKVLMDEFHHVSTA

FLELGKGYQEAIEDITKRMGAGMAKFICKEVETVDDYDEYCHYVAGLVGLGLSKLFHAAELEDL

APDSLSNSMGLFLQKTNIIRDYLEDINEIPKSRMFWPREIWGKYADKLEDFKYEENSVKAVQCL

NDLVTNALNHVEDCLKYMSNLRDLSIFRFCAIPQIMAIGTLALCYNNVEVFRGVVKMRRGLTAK

VIDRTKTMADVYGAFFDESVMLKAKVNSNDPNASKTLSRIEAIQQTCQQSGLMNKRKLYVVRSE

PMYNPAVIVILFSLLCIILAYLSAKRLPANQSV

*Cucumis melo*
(SEQ ID NO: 6)
MGSLGAILKHPDDFYPLLKLKMAARHAEKQIPPESHWGFCYTMLHKVSRSFALVIQQLKPBLRN

AVCIFYLVLRALDTVEDDTSIQTDIKVPILKAFHCHIYNRDWHFSCGTKDYKVLMDEFHHVSTA

FLELGKGYQEAIEDITKRMGAGMAKFICKEVETVDDYDEYCHYVAGLVGLGLSKLFHAAELEDL

APDSLSNSMGLFLQKTNIIRDYLEDINEIPKSRMFWPRBIWGKYADKLEDFKYEENSVKAVQCI

-continued

NDLVTNALNHVEDCPKYMSNLRDLSIFRFCAIPQIMAIGTLALCYNNVEVFRGVVEMRRGLTAK

VIDRTKTMADVYGAFFDFSVMLKAKVNSNDPNASKTLSRIEAIQQTCQQSGLMNKRKLYVVRSE

PMYNPAVIVILFSLLCIILAYLSAKRLPANQSV

*Cucurbita moschata* (SEQ ID NO: 7)

MGSLGAILRHPDDIYPLLKLKMAARHAEKQIPPESHWGFCYTMLHKVSRSFALVIQQLKPELRN

AVCIFYLVLRALDTVEDDTSIQTDIKVPILKAPHCHIYNRDWHFSCGTKDYKVLMDEFHHVSTA

FLELGRGYQEAIEDITKRMGAGMAKFICKEVETVEDYDEYCHYVAGLVGLGLSKLFHASKSENL

APDSLSNSMGLFLQKTNIIRDYLEDINEIPKSRMFWPREIWSKYADKLEDFKYEKNSVKAVQCL

NDLVTNALTHVEDCLEYMSNLKDLSIFRFCAIPQIMAIGTLALCYNNVDVFRGVVKMRRGLTAK

VIYRTKTMADVYGAFFDFSVMLKAKVNSSDPNASKTLTRIEAIQKTCKQSGLLNKRELYAVRSE

PMCNPAAIVVLFSLLCIILAYLSAKLLPANQPV

*Sechium edule* (SEQ ID NO: 8)

MGSLGAILSHPDDLYPLLKLKMAAKHAEKQIPPDPHWGFCFSMLHKVSRSFALVIQQLKPELRN

AVCIFYLVLRALDTVEDDTGIHPDIKVPILQAFHCHIYNRDWHFSCGTKHYKVLMDEFHHVSTA

FLELGKGYQEAIEDVTERMGAGMAKFICKEVETVDDYDEYCHYVAGLVGLGLSKLFHAAELEDL

APDSLSNSMGLFLQKTNIIRDYLEDINEIPKSRMFWPREIWNKYADKLEDFKYEENSVKAVQCL

NDLVTNALNHVEDCLKYMSNLKDLSTFRFCAIPQIMAIGTLALCYDNVEVFRGVVKMRRGLTAK

IIDRTKKIADVYGAFFDFSVMLKAKVNSSDPNAAKTLSRIEAIEKTCKESGLLNKRKLYVIRSE

PLFNPAVLVILFSLICILLAYLSAKRLPANQPV

*Panax quinquefolius* (SEQ ID NO: 9)

MGSLGAILKHPDDFYPLLKLKFAARHAEKQIPPEPHWAFCYSMLHKVSRSFGLVIQQLGPQLRD

AVCIFYLVLRALDTVEDDTSIPTEVKVPILMAFHRHIYDKDWHFSCGTKEYKVLMDEFHHVSNA

FLELGSGYQEAIEDITMRMGAGMAKFICKEVETIDDYDEYCHYVAGLVGLGLSKLFHASGAEDL

ATDSLSNSMGLFLQKTNIIRDYLEDINEIPKSRMFWPRQIWSKYVDKLEDLKYEENSAKAVQCI

NDMVTDALVHAEDCLKYMSDLRDPAIFRFCAIPQIMAIGTLALCFNNTQVFRGVVKMRRGLTAK

VIDRTKTMSDVYGAFFDFSCLLKSKVDNNDPNATKTLSRLEAIQKTCKESGTLSKRKSYITESE

SGHNSALIAIIFIILAILYAYLSSNLLLNKQ

*Malus domestica* (SEQ ID NO: 10)

MGALSTMLKHPDDIYPLLKLKIASRQIEKQIPAEPHWAFCYTMLQKVSRSFALVIQQLGTELRN

AVCLFYLVLRALDTVEDDTSVATDVKVPILLAFHRHIYDPDWHFACGTNNYKVLMDEFHHVSTA

FLELGTGYQEAIEDITKRMGAGMAKFILKEVETIDDYDEYCHYVAGLVGLGLSKLFHAAGKEDL

ASDSLSNSMGLFLQKTNIIRDYLEDINEIPKSRMFWPRQIWSKYVNKLEDLKYEENSEKAVQCL

NDMVTNALIHMEDCLKYMAALRDPAIFKFCAIPQIMAIGTLALCYNNIEVFRGVVKMRRGLTAK

VIDRTKSMDDVYGAFFDFSSILKSKVDKNDPNATKTLSRVEAVQKLCRDSGALSKRKSYIANRE

QSYNSTLIVALFIILAIIYAYLSASPRI

*Artemisia annua* (SEQ ID NO: 11)

MSSLKAVLKHPDDFYPLLKLKMAAKKAEKQIPSQPHWAFSYSMLHKVSRSFALVIQQLNPQLRD

AVCIFYLVLRALDTVEDDTSIAADIKVPILIAFHKHIYNRDWHFACGTKEYKVLMDQFHHVSTA

FLELKRGYQEAIEDITMRMGAGMAKFICKEVETVDDYDEYCHYVAGLVGIGLSKLFHSSGTEIL

FSDSISNSMGLFLQKTNIIRDYLEDINEIPKSRMFWPREIWSKYVNKLEDLKYEENSEKAVQCL

NDMVTNALIHIEDCLKYMSQLKDPAIFRFCAIPQIMAIGTLALCYNNIEVFRGVVKLRRGLTAK

-continued

VIDRTKTMADVYQAFSDFSDMLKSKVDMHDPNAQTTITRLEAAQKICKDSGTLSNRKSYIVKRE

SSYSAALLALLFTILAILYAYLSANRPNKIKFTL

*Glycine soja*
(SEQ ID NO: 12)
MDQRSEDEFYPLLKLKIVARNAEKQIPPEPHWAFCYTMLHKVSRSFALVIQQLGIELRNAVCIF

YLVLRALDTVEDDTSIETDVKVPILIAFHRHIYDRDWHFSCGTKEYKVLMGQFHHVSTAFLELG

KNYQEAIEDITKRMGAGMAKFICKEVETIDDYDEYCHYVAGLVGLGLSKLFHASGSEDLAPDDL

SNSMGLFLQKTNIIRDYLEDINEIPKSRMFWPRQIWSEYVNKLEDLKYEENSVKAVQCLNDMVT

NALMHAEDCLTYMAALRDPPIFRFCAIPQIMAIGTLALCYNNIEVFRGVVKMRRGLTAKVIDRT

KTMADVYGAFFDFASMLEPKVDKNDPNATKTLSRLEAIQKTCRESGLLSKRKSYIVNDESGYGS

TMIVILVIMVSIIFAYLSANHHNS

*Diospyros kaki*
(SEQ ID NO: 13)
MGSLAAMLRHPDDVYPLVKLKMAARHAEKQIPPEPHWAFCYTMLHKVSRSFGLVIQQLGTELRN

AVCIFYLVLRALDTVEDDTSIATEVKVPILLAFHHHIYDRDWHFSCGTREYKVLMDEFHHVSTA

FLELGKGYQEAIEDITMRMGAGMAKFICKEVETIDDYDEYCHYvAGLVGLGLSKLFHASGLEDL

APDSLSNSMGLFLQKTNIIRDYLEDINEIPKSRMFWPROIWSKYvNKLEDLKYEKNSVKSvQCL

NDMVTNALIHVDDCLKYMSALRDPAIFRFCAIPQIMAIGTLALCYNNIEVFRGVVKMRRGLTAK

VIDQTKTISDVYGAFFDFSCMLKSKVEKNDPNSTKTLSRIEAIQKTCRESGTLSKRKSYILRSK

RTHNSTLIFVLFIILAILFAYLSANRPPINM

*Euphorbia lathyris*
(SEQ ID NO: 14)
MGSLGAILKHPDDFYPLLKLKMAAKHAEKQIPAQPHWGFCYSMLHKVSRSFSLVIQQLGTELRD

AVCIFYLVLRALDTVEDDTSIPTDVKVPILIAFHKHIYDPEWHFSCGTKEYKVLMDQIHHLSTA

FLELGKSYQEAIEDITKKMGAGMAKFICKEVETVDDYDEYCHYVAGLVGLGLSKLFDASGFEDL

APDDLSNSMGLFLQKTNIIRDYLEDINEIPKSRMFWPRQIWSKYVNKLEDLKYEENSVKAVQCL

NDMVTNALIHMDDCLKYMSALRDPAIFRFCAIPQIMAIGTLALCYNNVEVFRGVVKMRRGLTAK

VIDRTRTMADVYRAFFDFSCMMKSKVDRNDPNAEKTLNRLEAVQKTCKESGLLNKRRSYINESK

PYNSTMVILLMIVLAIILAYLSKRAN

*Camellia oleifera*
(SEQ ID NO: 15)
MGSLGAILKHPDDFYPLMKLKMAARRAEKNIPPEPHWGFCYSMLHKVSRSFALVIQQLDTELRN

AVCIFYLVLRALDTVEDDTSIATEVKVPILMAFHRHIYDRDWHFSCGTKEYKVLMDEFHHVSTA

FSELGRGYQEAIEDITMRMGAGMAKFICKEVETIDDYDEYCHYVAGLVGLGLSKLFHASGSEDL

ASDSLSNSMGLFLQVFLLTCIKTNIIRDYLEDINEIPKSRMFWPRQIWSKYVNKLEDLKDKENS

VKAVECLNDMVTNALIHVEDCLTYMSALRDPSIFRFCAIPQIMAIGTLALCYNNIEVFRGVVKM

RRGLTAKVIDRTKTMSDVYGGFFDFSCMLKSKVNKSDPNAMKALSRLEAIQKICRESGTLNKRK

SYIIKSEPRYNSTLVFVLFIILAILFAYL

*Eleutherococcus senticosus*
(SEQ ID NO: 16)
MGSLGAILKHPDDFYPLLKLKFAARHAEKQIPPEPHWAFCYSMLHKVSRSFGLVIQQLDAQLRD

AVCIFYLVLRALDTVEDDTSIPTEVKVPILMAFHRHIYDKDWHFSCGTKEYKVLMDEFHHVSNA

FLELGSGFQEAIEDITMRMGAGMAKFICKEVETIDDYDEYCHYVAGLVGLGLSKLFHASGAEDL

ATDSLSNSMGLFLQKTNIIRDYLEDINEIPKSRMFWPRQIWSKYVDKLENLKYEENSAKAVQCL

NDMVTNALLHAEDCLKYMSNLRDPAIFRFCAIPQIMAIGTLALCFNNIQVFRGVVKMRRGLTAK

-continued

VIDRTKTMSDVYGAFFDFSCLLKSKVDNNDPNATKTLSRLEAIQKTCKESGTLSKRKSYIIESK

SAHNSALIAIIFIILAILYAYLSSNLPNNQ

*Flavobacteriales bacterium*
(SEQ ID NO: 166)
MLNNSLFSRLEEIPALLKLKLGSKDYYKNNNSETLTCDNLRYCFDTLNKVSRSFATVIKQLPNE

LGNNVCVFYLILRALDSIEDDMNLPKELKIKLLREFHKKNYESGWNISGVGDKKEHVELLENYD

KVIQSFLAIDQKNQLIITDICRKVGAGMANFVKAEIESVEDYNLYCHHVAGLVGIGLSRMFISS

GLENDDFLNQDEISNSMGLFLQKTNIVRDYREDLDEGRMFWPKDIWHVYGSKINDFAINPTHDQ

SVLCLNHMLNNALTHATDCLAYLKHLRNENIFKFCAIPQVMAMATLCKIYSNPDVFIKNVKIRK

GLAAKLILNTTSMDEVIKVYKDMLLVIESKISSDNNPVSAETIQLLKQIREYFNDETLIVRKIA

*Bacteroidetes bacterium*
(SEQ ID NO: 167)
MLNSSLFSRLEEIPALLKLKLGSINNYKNNNSENLTSKNLRYCFDTLNKVSRSFASVIKQLPNE

LMVNVCLFYLILRALDSIEDDMNLPKDFKINLLREFLDKNYEPGWKISGVGDKKEYVELLENYD

KVIQVFLDIDPKNQLIITDICRKMGAGMAHFVEAEINSVKDYNLYCYHVAGLVGIGLSKMFLAS

GLENCDYLNQEEISSSMGLFLQKTNIVRDYKEDMEENRIFWPKEIWRTYASKFSDFSINPQHET

SISCLNHMVNDALGHVIDCLEYLRHLRNENIFKFCAIPOVMAMATLCKVYNNPDVFIKTVKIRK

GLAAKLILNTTSMDEVIKVYKGLLLDIENKIPLHNPTSDETLRLIKNIRSYCNNETMVVSKTA

Squalene Epoxidase
*Siraitia grosvenorii* SQE1
(SEQ ID NO: 17)
MVDQCALGWILASALGLVIALCFFVAPRRNHRGVDSKERDECVQSAATTKGECRFNDRDVDVIV

VGAGVAGSALAHTLGKDGRRVHVIERDLTEPDRIVGELLQPGGYLKLIELGLQDCVEEIDAQRV

YGYALFKDGKNTRLSYPLENFHSDVSGRSFHNGRFIQRMREKAASLPNVRLEQGTVTSLLEEKG

TIKGVQYKSKNGEEKTAYAPLTIVCDGCFSNLRRSLCNPMVDVPSYFVGLVLENCELPFANHGH

VILGDPSPILFYQISRTEIRCLVDVPGQKVPSIANGEMEKYLKTVVAPQVPPQIYDSFIAAIDK

GNIRTMPNRSMPAAPHPTPGALLMGDAFNMRHPLTGGGMTVALSDIVVLRNLLKPLKDLSDAST

LCKYLESFYTLRKPVASTINTLAGALYKVFCASPDQARKEMRQACFDYLSLGGIFSNGPVSLLS

GLNPRPLSLVLHFFAVAIYGVGRLLLPFPSVKGIWIGARLIYSASGIIFPIIRAEGVRQMFFPA

TVPAYYRSPPVFKPIV

*Siraitia grosvenorii* SQE2
(SEQ ID NO: 18)
MVDQCALGWILASVLGAAALYFLFGRKNGGVSNERRHESTKNIATTNGEYKSSNSDGDIIIVGA

GVAGSALAYTLGKDGRRVHVIERDLTEPDRIVGELLQPGGYLKLTELGLEDCVDDIDAQRVYGY

ALFKDGKDTRLSYPLEKFHSDVAGRSFHNGRFIQRMREKAASLPKVSLEQGTVTSLLEENGIIK

GVQYKTKTGQEMTAYAPLTIVCDGCFSNLRRSLCNPKVDVPSCFVGLVLENCDLPYANHGHVIL

ADPSPILFYRISSTEIRCLVDVPGQKVPSISNGEMANYLKNVVAPQIPSQLYDSFVAATDKGNI

RTMPNRSMPADPYPTPGALLMGDAFNMRHPLTGGGMTVALSDVVVLRDLLKPLRDLNDAPTLSK

YLEAFYTLRKPVASTINTLAGALYKVFCASPDQARKEMRQACFDYLSLGGIFSNGPVSLLSGLN

PRPISLVLHFFAVAIYGVGRLLIPFPSPKRVWIGARIISGASAIIFPIIKAEGVRQMFFPATVA

AYYRAPRVVKGR

*Momordica charantia*
(SEQ ID NO: 19)
MVDECALGWILAAALGAVIALCLEVAPKTNNQDGGVDSKATPECVQTTNGECRSDGDSDVIIVG

AGVAGSALAHTLGKDGRRVHVIERDLTEPDRIVGELLQPGGYLKLIELGLADCVEEIDAQRVYG

YALFKDGKNTRLSYPLEKFHSDVSGRSFHNGRFIQRMREKADSLPNVRLEQGTVTSLLEEKGTI

-continued

KGVQYKSKDGKEKTAYAPLTIVCDGCFSNLRRSLCNPMVDVPSCFVGLVLENCQLPFANHGHVV

LGDPSPILFYPISSTEIRCLVDVPGQKVPSISNGEMEKYLKTVVAPQVPPQIYDAFIAAIDKGN

IRTMPNRSMPAAPHPTPGALLMGDAFNMRHPLTGGGMTVALSDIVVLRNLLKPLKDLHDAPTLC

KYLESFYTLRKPVASTINTLAGALYKVFCASPDQARKEMRQACFDYLSLGGMFSNGPVSLLSGL

NPRPLSLVLHFFAVAIYGVGRLLFPFPSPKGIWIGARLIYSASGIIFPIIKAEGVRQMFFPATV

PAYYRSPPALKPVA

Cucurbita maxima (SEQ ID NO: 20)
MVDYCAFGWILAAVLGLAIALSFFVSPRRNRRGGADSTPRSEGVRSSSTTNGECRSVDGDADVI

IVGAGVAGSALAHTLGKDGRLVHVIERDLTEPDRIVGELLQPGGYLKLIELGLQDCVEEIDAQK

VYGYALFKDGKNTQLSYPLEKFQSDVSGRSFHNGRFIQRMREKAASLPNVRLEQGTVTSLLEEK

GTIKGVQYKSKNGEEKTAYAPLTIVCDGCFSNLRRSLCKPMVDVPSCFVGLVLENCQLPFANHG

HVVLGDPSPILFYPISSTEIRCLVDVPGQKIPSISNGEMEKYLKTIVAPQVPPQIHDAFIAAID

KGNIRTMPNRSMPAAFQPrPGALLMGDAENMRHPLTGGGMIVALSD1VVLRNLLKPLKDLNDAL

TLCKYLESFYTLRKPVASTINTLAGALYKVFCASPDQARKEMRQACFDYLSLGGIFSNGPVSLL

SGLNPRPLSLVLHFFAVAIYGVGRLLLPFPSPKGIWIGARLVYSASGIIFPIIKAEGVRQMFFP

ATVPAYYRSPPVHKSIA

Cucurbita moschata (SEQ ID NO: 21)
MVDYCAFGWILAAVLGLAIALSFFVSPRRNRRGGADSTPRSEGVRSSSTTNGECRSVDCDADVI

IVGAGVAGSALAHTLGKDGRLVHVIERDLTEPDRIVGELLQPGGYLKLIELGLQDCVEEIDAQK

VYGYALFKDGKNTQLSYPLEKFQSDVSGRSFHNGRFIQRMREKAASLPNVRLEQGTVTSLLEEK

GTIKGVQYKSENGBEKTAHAPLTTVCDGCFSNLRRSLCKPMVDVPSCFVGLVLENCQLPFANHG

HVVLGDPSPILFYPISSTEIRCLVDVPGQKVPSISNGEMEKYLKTIVAPQVPPQIHDAFIAAID

KGNIRTMPNRSMPAAPQPTPGALLMGDAFNMRHPLTGGGMTVALSDIVVLRNLLKPLKDLNDAP

TLCKYLESFYTLRKPVASTINTLAGALYKVFCASPDQARKEMRQACFDYLSLGGIFSNGPVSLL

SGLNPRPLSLVLHFFAVAIYGVGRLLLPFPSPKGIWIGARLVYSASGIIFPIIKAEGVRQMFFP

ATVPAYYRSPPVIKTIA

Cucurbita moschata (SEQ ID NO: 22)
MMVDHCAFAWILDVVLGLVVAVTFFVAAPRRNRRGGTDSTASKDCVISTAIANGECKPDDADAE

VIIVGAGVAGSALAYTLGKDGRRVHVIERDLTEPDRIVGEFLQPGGYLKLIELGLGDCVEEIDA

QKLYGYALFKDGKNTRVSYPLGNFHSDVSGRSFHNGRFIQRMREKAASLPNVRLEQGTVTSLLE

TKGTIKGVQYKSKNGEEKTAYAPLTIVCDGCFSNLRRSLCKPMVDVPSCFVGLVLENCQLPFAN

HGHVVLGDPSPILFYPISSTEIRCLVDVPGQKVPSISNGDMEKYLKTVVAPQVPPQIHDAFIAA

IEKGNVRTMPNRSMPAAPHPTPGALLMGDAFNMRHPLTGGGMTVALSDIVVLRNLLKPLKDLND

ASTLCKYLESFYTLRKPVASTINTLAGALYKVFCASPDQARKEMRQACFDYLSLGGVFSNGPIS

LLSGLNPRPSSLVLHFFAVAIYGVGRLLLPFPSLKGIWIGARLIYSASGIILPIIKAEGVRQMF

FPATVPAYYRSPPVHKPIT

Cucumis sativus (SEQ ID NO: 23)
MVDHCTFGWIFSAFLAFVIAFSFFLSPRKNRRGRGTNSTPRRDCLSSSATTNGECRSVDGDADV

IIVGAGVAGSALAHTLGKDGRVHVIERDLTEPDRIVGELLQPGGYLKLIELGLQDCVEEIDAQ

KVYGYALFKDGKSTRLSYPLENFQSDVSGRSFHNGRFIQRMREKAAFLPNVRLEQGTVTSLLEE

KGTITGVQYKSKNGEQKTAYAPLTIVCDGCFSNLRRSLCNPMVDVPSCFVGLVLENCQLPYANL

-continued

GHVVLGDPSPILFYPISSTEIRCLVDVPGQKVPSISNGEMEKYLKTVVAPQVPPQIHDAFIAAI

EKGNIRTMPNRSMPAAPQPTPGALLMGDAFNMRHPLTGGGMTVALSDIVVLRNLLKPLKDLNDA

PTLCKYLESEYTLRKPVASTINTLAGALYKVFCASSDQARKEMRQACFDYLSLGGIESNGPVSL

LSGLNPRPLSLVLHFFAVAIYGVGRLLLPFPSPKGIWIGARLVYSASGIIFPIIKAEGVRQMFF

PATVPAYYRTPPVFNS

*Cucurais melo* (SEQ ID NO: 24)
MVDHCAFGWIFSALLAFPIALSLFLSPWRNRRVRGTDSTPRSASVSSSATTNGECRSVDGDADV

VIVGAGVAGSALAHTLGKDGRRVHVIERDLTEPDRIVGELLQPGGYLKLIELGLQDCVEEIDAQ

KVYGYALFKDGKNTRLSYPLENFHSDVSGRSFHNGRFTQRMREKAASLPNVRLEQGTVTSLLEE

KGTITGVQYKSKNGBQKTAYAPLTIVCDGCFSNLRRSLCTPMVDVPSYFVGLVLENCQLPYANL

GHVVLGDPSPILFYPISSTEIRCLVDVPGQKVPSISNGEMEKYLKTVVAPQVPPQIHDAFIAAI

EKGNTRTMPNRSMPAAPQPTPGALLMGDAFNMRHPLTGGGMTVALSDIVVLRNLLKPLKDLNDA

PTLCKYLESFYTLRKPVASTINTLAGALYKVFCASPDQARKEMRQACFDYLSLGGIFSNGPVSL

LSGLNPRPLSLVLHFFAVAIYGVGRLLLPFPSLKGIWIGARLVYSASGIIFPIIKAEGVRQMFF

PATVPAYYRTPPVLNS

*Cucurbits maxima* (SEQ ID NO: 25)
MMVEHCAYGWILAAVLGLVVAVTFFVAVPRRNRRGGTDSTASKDCVISPAIANGECEPEDADAD

ADVIIVGAGVAGSALAHTLGKDGRRVHVIERDLTEPDRIVGEFLQPGGHLKLIELCLGDCVEEI

DAQKLYGYALFKDGKNTRVSYPLGNFHSDVSGRSFHNGRFIQRMREKAASLPNVRLEQGTVTSL

LEKKGTIKGVQYKSKNGEEKTAYAPLTIVCDGCFSNLRRSLCKPMVDVPSCFVGLVLENCRLPF

ANHGHVVLGDPSPILFYPISSTEIRCLVDVPGQKVPSIPNGDMEKYLKTVVAPQVPPQIHDAFI

AAIEKGNIRTMPNRSMPAAPHPTPGALLMGDAFNMRHPLTGGGMTVALSDIVVLRNLLKPLKDL

NDAPTLCKYLESYYTLRKPVASTINTLAGALYKVFCASPDQARKEMRQACFDYLSLGGVFSNGP

ISLLSGLNPRPSCLVLHFFAVAIYGVGRLLLPFPSLKGIWIGARLIYSASGIILPIIKAEGVRQ

MFFPATVPAYYRSPPVHKPIT

*Ziziphus jujube* (SEQ ID NO: 26)
MLDQCPLGWILASVLGLFVLCNLIVKNRNSKASLEKRSECVKSIATTNGECRSKSDDVDVIIVG

AGVAGSALAHTLGKDGRRLHVIERDLTEPDRIVGELLQPGGYLKLIELGLQDCVEEIDAQRVFG

YALFKDGKDTRLSYPLEKFHSDVSGRSFHNGRFIQRMREKSASLPNVRLEQGTVTSLLEEKGTI

KGVQYKTKTGQELTAFAPLTIVCDGCFSNLRRSLCNPKVDVPSCFVGLVLENCELPYANHGHVI

LADPSPILFYPISSTEVRCLVDVPGQKVPSISNGEMARYLKSVVAPQIPPQIYDAFIAAVDKGN

IRTMPNRSMPASPFPTPGALLMGDAFNMRHPLTGGGMTVALSDIVVLRDLLKPLGDLNDAATLC

KYLESFYTLRKPVASTINTLAGALYKVFCASPDQARKEMRQACFDYLSLGGIFSTGPVSLLSGL

NPRPLSLVLHFFAVAIYGVGRLLLPFPSPKRIWIGARLISGASGIIFPIIKAEGVRQMFFPATV

PAYYRAAPVE

*Morus alba* (SEQ ID NO: 27)
MADPYTMGWILASLLGLFALYYLFVNNKNHREASLQESGSECVKSVAPVKGECRSKNGDADVII

VGAGVAGSALAHTLGKDGRRVHVIERDLAEPDRIVGELLQPGGYLKLIELGLQDCVEEIDSQRV

YGYALFKDGKDTRLSYPLEKFHSDVSGRSFHNGRFIQRMREKAASLPNVQLEQGTVTSLLEENG

TIKGVQYKTKTGQELTAYAPLTIVCDGCFSNLRRSLCIPKVDVPSCFVGLVLENCNLPYANHGH

-continued

```
VVLADPSPILFYPISSTEVRCLVDVPGQKVPSISNGEMAKYLKTVVASQIPPQIYDSFVAAVDK

GNIRTMPNRSMPAAPHPTPGALLMGDAFNMRHPLTGGGMTVALSDIVVLRDLLKPLRDLNDSVT

LCKYLESFYTLRKPVASTINTLAGALYKVFCASPDQARKEMREACFDYLSLGGVFSEGPVSLLS

GLNPRPLSLVCHFFAVAIYGVGRLLLPFPSPKRLWIGARLISGASGIIFPIIRAEGVRQMFFPA

TIPAYYRAPRPN
```

*Juglans regia* (JrSQE1)  (SEQ ID NO: 28)
```
MVDPYALGWSFASVLMGLVALYILVDKKNRSRVSSEARSEGVESVTTTTSGECRLTDGDADVII

VGAGVAGSALAHTLGKDGRRVHVIERDLTEPDRIVGELLQPGGYLKLIELGLEDCVEDIDAQRV

FGYALFKDGKNTRLSYPLEKFHSDVSGRSFHNGRFIQRMREKAASLLNVRLEQGTVTSLLEENG

TVKGVQYKTKDGNELTAHAPLTIVCDGCFSNLRRSLCNPQVDVPSSFVGLVLENCELPYANHGH

VILADPSPILFYPISSTEVRCLVDVPGKKVPSIANGEMEKYLKNMVAPQLPPEIYDSFVAAVDR

GNIRTMPNRSMPAAPHPTPGALLMGDAFNMRHPLTGGGMTVALSDIVVLRDLLKPLRDLNDAPT

LCKYLESFYTLRKPVASTINTLAGALYKVFCASPDRARKEMRQACFDYLSLGGVFSMGPVSLLS

GLNPRPLSLVLHFFAVAVYGVGRLLVPFPSPSRIWIGARLISGASAIIFPIIKAEGVRQMFFPA

TVPAYYRAPPVKRDH
```

*Cucumis melo*  (SEQ ID NO: 29)
```
MVDQCALGWILASVLGASALYLLFGKKNCGVLNERRRESLKNIATTNGECKSSNSDGDIIIVGA

GVAGSALAYTLAKDGRQVHVIERDLSEPDRIVGELLQPGGYLKLTELGLEDCVDDIDAQRVYGY

ALFKDGKDTRLSYPLEKFHSDVSGRSFHNGRFIQRMREKAASLPNVRLEQGTVTSLLEENGTIK

GVQYKNKSGQEMTAYAPLTIVCDGCFSNLRRSLCNPKVDVPSCFVGLILENCDLPYANHGHVII

ADPSPILFYPISSTEIRCLVDVPGQKVPSISNGEMANYLKNVVAPQIPPQLYNSFIAAIDKGNI

RTMPNRSMPADPYPTPGALLMGDAFNMRHPLTGGGMTVALSDIVVLRDLLKPLRDLNDAPTLCK

YLEAFYTLRKPVASTINTLAGALYKVFCASPDQARKEMRQACFDYLSLGGIFSNGPVSLLSGLN

PRPLSLVLHFFAVAIYGVGRLLIPFPSPKRVWIGARLISGASAIIFPIIKAEGVRQMFFPKTVA

AYYRAPPVVRER
```

*Cucumis sativus*  (SEQ ID NO: 30)
```
MVDQCALGWILASVLGASALYLLFGKKNCGVSNERRRESLKNIATTNGECKSSNSDGDIIIVGA

GVAGSALAYTLAKDGRQVHVIERDLSEPDRIVGELLQPGGYLKLTELGLEDCVDEIDAQRVYGY

ALFKDGKDTRLSYPLEKFHSDVSGRSFHNGRFIQRMREKAASLPNVRLEQGTVTSLLEENGTIR

GVQYKNKSGQEMTAYAPLTIVCDGCFSNLRRSLCNPKVDVPSCFVGLILENCDLPHANHGHVIL

ADFSPILFYPISSTEIRCLVDVPGQKVPSISNGEMANYLKNVVAPQIPPQLYNSFIAAIDKGMI

RTMPNRSMPADPYPTPGALLMGDAFNMRHPLTGGGMTVALSDIVVLRDLLKPLRDLNDAPTLCK

YLEAFYTLRKPVASTINTLAGALYKVFCASPDQARKEMRQACFDYLSLGGIFSNGPVSLLSGLN

PRPLSLVLHFFAVAIYGVGRLLIPFPSPKRVWIGARLISGASAIIFPIIKAEGVRQMFFPKTVA

AYYRAPPIVRER
```

*Juglans regia* (JrSQE2)  (SEQ ID NO: 31)
```
MVDQYALGLILASVLGFVVLYNLMAKKNRIRVSSEARTEGVQTVITTTNGECRSIEGDVDVIIV

GAGVAGSALAHTLGKDGRKVHVIERDLSEPDRIVGELLQPGGYLKLVELGLQDSVEDIDAQRVF

GYALFKDGKNTRLSYPLEKFHSDVSGRSFHNGRFIQRMREKAASLPNIRLEQGTVTSLLEENGT

IKGVQYKTKDGKELAAHAPLTIVCDGCFSNLRRSLCNPQVDVPSSFVGLVLENCELPYANHGHV

VLADPSPILFYPISSTEVRCLVDVPGQKVPSISNGEMAKYLKTMVAPQVPPEIYDSFVAAVDRG
```

-continued

NIRTMPNRSMPAAPQPTPGALLMGDAFNMRHPLTGGGMTVALSDIVVLRDLLRPLRDLNDAPTL

CKYLESFYTLRKPVASTINTLAGALYKVFCASPDRARNEMRQACFDYLSLGGVFSTGPvSLLSG

LNPRPLSLVLHFFAVAVYGVGRLLVPFPSPSRMWIGARLISGASAIIFPIIKAEGVRQMFFPAT

VPAYYRAPPVNCQARSLKPDALKGL

*Theobroma cacao*
(SEQ ID NO: 32)
MADSYVWGWILGSVMTLVALCGVVLKRRKGSGISATRTESVKCVSSINGKCRSADGSDADVIIV

GAGVAGSALAHTLGKDGRRVHVIERDLTEPDRIVGELLQPGGYLKLIELGLEDCVEEIDAQQVF

GYALFKDGKHTRLSYPLEKFHSDVSGRSFHNGRFIQRMREKSASLPNVRLEQGTVTSLLEEKGT

IRGVQYKTKDGRELTAFAPLTIVCDGCFSNLRRSLCNPKVDVPSCFVGLVLENCNLPYSNHGHV

ILADPSPILFYPISSTEVRCLVDVPGQKVPSIANGEMANYLKTIVAPQVPPEIYNSFVAAVDKG

NIRTMPNRSMPAAPYPTPGALLMGDAFNMRHPLTGGGMTVALSDIVVLRDLLRPLRDLNDAPTL

CKYLESEYTLRKPIASTINTLAGALYKVFCASPDQARKEMRQACFDYLSLGGVFSTGPISLLSG

LNPRPVSLVLHFFAVAIYGVGRLLLPFPSPKRIWIGARLISGASGIIFPIIKAEGVRQMFFPAT

VPAYYRAPPVE

*Cucurbita moschata*
(SEQ ID NO: 33)
MMVDHCAFAWTLDVVLGLVVAVTFFVAAPRRNRRGGTDSTASKDCVISTAIANGECKPDDADAE

VIIVGAGVAGSALAYTLGKDGRRVHVIERDLTEPDRIVGEFLQPGGYLKLIELGLGDCVEEIDA

QKLYGYALFKDGKNTRVSYPLGNFHSDVSGRSFHNGRFIQRMREKAASLPNVRLEQGTVTSLLE

TKGTTKGVQYKSKNGEEKTAYAPLTIVCDGCFSNLRRSLCKPMVDVPSCFVGLVLENCQLPFAN

HGHVVLGDPSPILFYPISSTEIRCLVDVPGQKVPSISNGDMEKYLKTVVAPQVPPQIHDAFIAA

IEKGNVRTMPNRSMPAAPHPTPGALLMGDAFNMRHPLTGGGMTVALSDIVVLRNLLKPLKDLND

ASTLCKYLESFYTLRKPVASTINTLAGALYKVFCASPDQARKEMRQACFDYLSLGGVFSNGPIS

LLSGLNPRPSSLVLHFFAVAIYGVGRLLLPFPSLKGIWIGARLIYSASGIILPIIKAEGVRQMF

FPATVPAYYRSPPVHKPIT

*Phaseolus vulgaris*
(SEQ ID NO: 34)
MLDTYVFGWIICAALSVFVIRNFVFAGKKCCASSETDASMCAENITTAAGECRSSMRDGEFDVL

IVGAGVAGSALAYTLGKDGRQVLVIERDLSEPDRIVGELLQPGGYLKLIELGLEDCVDKIDAQQ

VFGYALFKDGKHIRLSYPLEKFHSDVAGRSFHNGRFIQRMREKAASLPNVRLEQGTVTSLLEEK

GVIKGVQYKTKDSQELSVCAPFTIVCDGCFSNLRRSLCDPKVDVPSCFVGLVLENCELPCANHG

HVILGEPSPVLFYPISSTEIRCLVDVPGQKVPSISNGEMAKYLKTVIAPQVPHELHNAFIAAVD

KGSIRTMPNRSMPAAPYPTPGALLMGDAFNMRHPLTGGGMTVALSDIVVLRNLLRPLRDLNDAP

SLCKYLESFYTLRKPVASTINTLAGALYKVFCASSDPARKEMRQACFDYLSLGGQFSEGPISLL

SGLNPRPLTLVLHFFAVATYGVGRLLLPFPSPKRMWIGLRLISSASGIIMPIIKAEGVRQMFFP

ATVPAYYRNPPAA

*Hevea brasiliensis*
(SEQ ID NO: 35)
MKMADHYLLGWILASVMGLFAFYYIVYLLVKPEEDNNRRSLPQPRSDFVKTMTATNGECRSDDD

SDVDVIIVGAGVAGAALAHTLGKDGRRVHVIERDLTEPDRIVGELLQPGGYLKLIELGLEDCVE

EIDAQRVFGYALFKDGKHTQLAYPLEKFHSEVAGRSFHNGRFIQRMREKAASLPSVKLEQGTVT

SLLEEKGTIKGVLYKTKTGEELTAFAPLTIVCDGCFSNLRRSLCNPKVDVPSCFVGLVLENCRL

PYANNGHVILADPSPILFYPISSTEVRSLVDVPGQKVPSVSSGEMANYLKNVVAPQVPPEIYDS

-continued

FVAAVDKGNIRTMPNRSMPASPYPTPGALLMGDAFNMRHPLTGGGMTVALSDIVVLRDLLKPLR

DLHDAPTLCRYLESFYTLRKPVASTINTLAGALYKVFCASPDEARKEMRQACFDYLSLGGVFST

GPVSLLSGLNPRPLSLVLHFFAVAIYGVGRLLLPFPSPHRIWVGARLISGASGIIFPIIKAEGV

ROMFFPATVPAYYRAPPIKCN

*Sorghum bicolor*

(SEQ ID NO: 36)
MAAAAAASGVGFQLIGAAAATLLAAVLVAAVLGRRRRRARPQAPLVEAKPAPEGGCAVGDGRT

DVIIVGAGVAGSALAYTLGKDGRRVHVIERDLTEPDRIVGELLQPGGYLKLIELGLEDCVEEID

AQRVLGYALFKDGRNTKLAYPLEKFHSDVAGRSFHNGRFTQRMRQKAASLPNVQLEQGTVTSLL

EENGTVKGVQYKTKSGEELKAYAPLTIVCDGCFSNLRRALCSPKVDVPSCFVGLVLENCQLPHP

NHGHVILANPSPILFYPISSTEVRCLVDVPGQKVPSIASGEMANYLKTVVAPQIPPEIYDSFIA

AIDKGSIRTMPNRSMPAAPHPTPGALLMGDAFNMRHPLTGGGMTVALSDIVVLRNLLKPLHNLH

DASSLCKYLESFYTLRKPVASTINTLAGALYKVFSASPDQARNEMRQACFDYLSLGGVFSNGPI

ALLSGLNPRPLSLVAHFFAVAIYGVGRLMLPLPSPKRMWIGARLISGACGIILPIIKAEGVRQM

FFPATVPAYYRAAPMGE

*Zea mays*

(SEQ ID NO: 37)
MRKNLEEAGCAVSDGGTDVIIVGAGVAGSALAYTLGKDGRRVHVIERDLTEPDRIVGELLQPGG

YLKLIELGLQDCVEEIDAQRVLGYALFKDGRNTKLAYPLEKFHSDVAGRSFHNGRFIQRMRQKA

ASLPNVQLEQGTVTSLLEENGTVKGVQYKTKSGEELKAYAPLTIVCDGCFSNLRRALCSPKVDV

PSCFVGLVLENCQLPHPNEGHVILANPSPILFYPISSTEVRCLVDVPCQKVPSIATGEMANYLK

TVVAPQIPPEIYDSFIAAIDKGSIRTMPNRSMPAAPHPTPGALLMGDAFNMRHPLTGGGMTVAL

SDIVVLRNLLKPLRNLHDASSLCKYLESFYTLRKPVASTINTLAGALYKVFSASPDQARNEMRQ

ACFDYLSLGGVFSNGPIALLSGLNPRPLSLVAHFFAVAIYGVGRLMLPLPSPKRMWIGARLISG

ACGIILPIIKAEGVRQMFFPATVPAYYRAAPTGEKA

*Medicago sativa*

(SEQ ID NO: 38)
MDLYNIGWILSSVLSLFALYNLIFSGKRNYHDVNDKVKDSVTSTDAGDIQSEKLNGDADVIIVG

AGIAGAALAHTLGKDGRRVHIIERDLSEPDRIVGELLQPGGYLKLVELGLQDCVDNIDAQRVFG

YALFKDGKHTRLSYPLEKFHSDVSGRSFHNGRFIQRMREKAASLPNVNMEQCTVISLLEEKGTI

KGVQYKNKDGQALTAYAPLTIVCDGCFSNLRRSLCNPKVDNPSCFVGLILENCELPCANHGHVI

LGDPSPILFYPISSTEIRCLVDVPGTKVPSISNGDMTKYLKTTVAPQVPPELYDAFIAAVDKGN

IRTMPNRSMPADPRPTPGAVLMGDAFNMRHPLTGGGMTVALSDIVVLRNLLKPMRDLNDAPTLC

KYLESFYTLRKPVASTINTLAGALYKVFSASPDEARKEMRQACFDYLSLGGLFSEGPISLLSGL

NPRPLSLVLHFFAVAVFGVGRLLLPFPSPKRVWIGARLLSGASGIILPIIKAEGIRQMFFPATV

PAYYRAPPVNAF

*Methylomonas lenta*

(SEQ ID NO: 39)
MKEEFDICIIGAGMAGATISAYLAPKGIKIALIDHCYKEKKRIVGELLQPGAVLSLEQMGLSHL

LDGFEAQTVKGYALLQGNEKTTIPYPSQHEGIGLHNGRFLQQIRASALENSSVTQIHGKALQLL

ENERNEIIGVSYRESITSQIKSIYAPLTITSDGFFSNFRAHLSNNQKTVTSYFIGLILKDCEMP

FPKHGHVFLSGPTPFICYPISDNEVRLLIDFPGEQLPRKNLLQEHLDTNVTPYIPECMRSSYAQ

AIQEGGFKVMPNHYMAAKPIVRKGAVMLGDALNMRHPLTGGGLTAVFSDIQILSAHLLAMPDFK

NTDLIHEKIEAYYRDRKRANANLNILANALYAVMSNDLLKTAVFKYLQCGGANAQESIAVLAGL

NRKHFSLIKQFCFLAVFGACNLLQQSISNIPKALKLLKDAFVIIKPLIKNELS

-continued

*Bathymodiolus azoricus* Endosymbiont
(SEQ ID NO: 168)
MHTTSEHNDLFDICIVGAGMAGATIATYLAPRGIKIALIDRDYAEKRRIVGELLQPGAVQTLKK

MGLEHLLEGFDAQPIYGYALFNKDCEFSIEYNQDKSTNYRGVGLHNGRFLQKIREDALKQPSIT

QIHGTVSELIEDENHVVTGVKYKEKYTRELKTVNAKLTITSDGFFSSFRKDLTNNVKTVTSFFV

GIILKDCELPYPHHGHVFLSAPTPFICYPISSTESRLLIDFPGDQAPKKEAVKHHIENNVIPFL

PKEFRLCLDQALRENDYKIMPNHYMPAKPVLKKGvVLLGDALNMRHPITGGGLTAVFNDVYLLS

THLLAMPDFNDTKLIHSKVNLYYNDRYHANTNVNIMANALYGVMSNDLLKQSVFEYLRKGGDNS

GGPISLLAGLNRNPTILIKHFFSVALLCLRNLFKAHKMSLTNAFYVIKDAFCIIVPLAINELRP

SSFLKKNIHN

*Methyloprofundus sediment*
(SEQ ID NO: 169)
MNTSPEHNDLFDICIVGVGMAGATIAAYLAPRGLKIALIDREYTEKRRIVGELLQPGAVQTLKK

MGLEHLLEGFDAQPIYGYALFNNDKEFSISYNSDDSTEYHGVGLHNGRFLQKIREDVFKNETVT

QIHGTVSELIEDKKGVVKGVTYREKHTREYKTVKAKLTVTSDGFFSNFRKDLSNNVKTVTSFFI

GLVLNDCNLPFPNHGHVFLSAPTPFICYPISSTETRLLIDYPGDKAPKKDEIREHILNKVAPFL

PEEFKECFANAMEDDDFKVMPNHYMPAKPVLKEGAVLLGDALNMRHPLTGGGLTAVFNDVYLLS

THLLAMPDFNDPKLLHEKLELYYQDRYHANTNVNIMANALYGVMSNDLLKQGVFEYLRKGGDNS

GGPITLLAGLNRNPTLLIKHFFSVAFLCICNLSGNNKMNFTNVFRVMKDAFCIIKPLAVNELRP

SSFYKKNIQL

*Methylomicrobium buryatense*
(SEQ ID NO: 170)
MESNFDICIIGAGMAGATIAAYLAPKGINIALIDHCYKEKKRIVGELLQPGAVLSLEQLGLGHL

LDGIDAQPVEGYALLQGNEQTTIPYPSPNHGMGLHNGRFLQQIRASALQNSSVTQIQGKALSLL

ENEQNEIIGVNYRDSVSNEIKSIYAPLTITSDGFFSNFRELLSNNEKTVTSYFIGLILKDCEIP

VPKHGHVFLSGPTPFICYPISSNEVRLLIDFPGGQFPRKAFLQAHLETNVTPYIPEGMQTSYRH

ALQEDRLKVMPNHYMAAKPKIRKGAVMLGDALNMRHPLTGGGLTAVFSDIEILSGHLLAMPDFN

NNDLIYQKIEAYYRDRQYANANLNILANALYGVMSNELLKNSVFKYLQRGGVNAKESIAILAGL

NKNHYSLMKQFFFVALFGAYTLVRENITNLPKATKILSDALTIIKPLAKNELSLVCIFSDYFKR

*Ononis spinosa* SQE1
(SEQ ID NO: 177)
MVDPYAVGWIICSLTTIVALYNFVFYRQNRSDKTTPTTTENITTATGDCRSLNPNGDVDIVIVG

AGVAGSALAYTLGKDGRRVLVIERDLNEPDRIVGELLQPGGYLKLIELGLEDCVEKIDAQQVFG

YALFKDGKHTRLSYPLEKFHSDIAGRSFHNGRFIQRMREKAASLPNVQLVQGTVTSLLEENGTI

KGVQYKTKDAQELSACAPLTIVCDGCFSNLRRNLCNPKVEVPSCFVGLVLENCELPCANHGHVI

LGDPSPVLFYPISSTEIRCLVDVPGQKVPSISNGEMAKYLKEVVAPQVPPELHDAFIAAVDKGN

IRTMPNRSMPAAPYPTPGALLMGDAFNMRHPLTGGGMTVALSDIVVLRNLLKPLRDLNDAPSLC

KYLESFYTLRKPVASTINTLAGALYKVFCASPDPARKEMRQACFDYLSLGGLFSEGPVSLLSGL

NPRPLSLVLHFFAVAIYGVGRLLLPFPSPKRIWIGVRLIASASGIILPIIKAEGIRQMFFPATV

PAYYRTPPAA

*Ononis spinosa* SOE2
(SEQ ID NO: 178)
MDLYLLGWILSSVLSLFALYCLVFDGNRSRANAEKQIQRGYSVTTDAGDVKSEKLNGDADVIIV

GAGIAGAALAETLGKDGRRVRVIERDLSEPDRIVGELLQPGGYLKLVELGLADCVDNIDAQKVE

GYALFKDGKHTRLSYPLEKFHADVSGRSFHNGRFIQRMREKAASLLNVNLEQGTVTSLLEEKGT

```
IKGVQYKNKDGQELTAYAPLTIVCDGCFSNLRRSLCNPKVDNPSCFVGLVLENCELPCANHGHV

ILGDPSPILFYPISSTEIRCLVDVPGQKVPSISNGDMTKYLKLTVAPQVPPELYDAFIAAVDKG

NIRTMPNKSMPADPCPTPGAVLMGDAFNMRHPLTGGGMTVALSDIVVLRNLLRPLRDLNDAPAL

CKYLESFYTLRKPVASTINTLAGALYKVFSSSPDQARREMRQACFDYLSLGGLFSEGPISLLSG

LNPRPLSLVLEFFAVAVFGVGRLLLPFPSPKRVWIGARLLSAASGIILPIIKAEGIRQMFFPVT

VPAYYRAPPTSQE
```

Medicago truncatula SQE1
(SEQ ID NO: 179)
```
MIDPYGFGWITCTLITLAALYNFLFSRKNHSDSTTTENITTATGECRSFNPNGDVDIIIVGAGV

AGSALAYTLGKDGRRVLIIERDLNEPDRIVGELLQPGGYLKLIELGLDDCVEKIDAQKVFGYAL

FKDGKHTRLSYPLEKFHSDIAGRSFHNGRFILRMREKAASLPNVRLEQGTVTSLLEENGTIKGV

QYKTKDAQEFSACAPLTIVCDGCFSNLRRSLCNPKVEVPSCFVGLVLENCELPCADHGHVILGD

PSPVLFYPISSTEIRCLVDVPGQKVPSISNGEMAKYLKTVVAPQVPPELHAAFIAAVDKGHIRT

MPNRSMPADPYPTPGALLMGDAFNMRHPLTGGGMTVALSDIVVLRNLLKPLRDLNDASSLCKYL

ESFYTLRKPVASTINTLAGALYKVFCASPDPARKEMRQACFDYLSLGGLFSEGPVSLLSGLNPC

PLSLVLHFFAVAIYGVGRLLLPFPSPKRLWIGIRLIASASGIILPIIKAEGIRQMFFPATVPAY

YRAPPDA
```

Medicago truncatula SQE2
(SEQ ID NO: 180)
```
MDLYNIGWILSSVLSLFALYNLIFAGKKNYDVNEKVNQREDSVTSTDAGEIKSDKLNGDADVII

VGAGIAGAALAHTLGKDGRRVHIIERDLSEPDRIVGELLQPGGYLKLVELGLQDCVDNIDAQRV

FGYALFKDGKETRLSYPLEKFHSDVSGRSFHGRFIQRMREKAASLPNVNMEQGTVISLLEEKGT

IKGVQYKNKDGQALTAYAPLTIVCDGCFSNLRRSLCNPKVDNPSCFVGLILENCELPCANHGHV

ILGDPSPILFYPISSTEIRCLVDVPGTKVPSISNGDMTKYLKTTVAPQVPPELYDAFIAAVDKG

NIRTMPNRSMPADPRPTPGAVLMGDAFNMRHPLTGGGMTVALSDIVVLRNLLKPMRDLNDAPTL

CKYLESFYTLRKPVASTINTLAGALYKVFSASPDEARKEMRQACFDYLSLGGLFSEGPISLLSG

LNPRPLSLVLHEFAVAVFGVGRLLLPFPSPKRVWIGARLLSGASGIILPIIKAEGIRQMFFPAT

VPAYYRAPPVNAF
```

Hypholoma sublateritium SQE
(SEQ ID NO: 181)
```
MSKSRSNYDVIIVGAGIAGCALAHGLSTLSRATPLRIAIVERSLAEPDRIVGELLQPGGVMALQ

RLGMEGCLEGIDAVKVHGYCVVENGTSVHIPYPGVHEGRSFHHGRFIMKLREAARAARGVELVE

ATVTELIPREGGKGIAGVRVARKGKDGEEDTTEALGAALVVVADGCFSNFRAAVMGGAAVKPET

KSHFVGAILKDARLPIPNHGTVALVKGFGPVLLYQISEHDTRMLVDVKAPLPADLKVCAHILSN

IVPQLPAALHLPIQRALDAERLRRMPNSFLPPVEQGATRGAVLVGDAWNMRHPLTGGGMTVALN

DVCCLRDLLGSVGDLGDWRQVASTVNILSVALYDLFGADGELQVLRTGCFKYFERGGDCIDGPV

SLLSGIAPSPMLLAYHFFSVAFYSIYVIAVGAQNGSAKQVLAVPGALQYPALCVKGLRVFYTAC

VVFGPLLWTELRW
```

Hypholoma sublateritium SQE2
(SEQ ID NO: 182)
```
MHPTHYDVVIVGAGVAGSSLAHALATLPREKPLQIALIERSFEEPDRIVGELLQPGGVDALKTL

KMTSSVEGIDAITVTGYILVESGDMVRTPYPKGKEGRSFHHGRFIMGLRRVALENPNVHPIEAT

AADLIECPCTGQVIGVRATSKTAPAPSSIDAQQTPPAPFSVYGDLVIVADGCFSNFRNVVMGKA

ACKATTKSYFVGTILKDAVLPVAGHGTVILPQGSGPVLLYQISEHDTRMLIDIQHPLPSDLRAH

ILTNILPQLPASIQGVVSDAPTKDRIRRMPNSFLPSVQQGSPLSKKGVILLGDSWNMRHPLTGG
```

```
GMTVALNDVVYLRSIFASIQNLDDWDEIRYALRHWHWGRKPLSSTINILSGTLYGLFEKDDDDY

RATRKGCFKYFQLGGKCIDDPVSLLSGLSPSPTLLSSHFFAVTLYAIWVVPTHPRVGSSMSANP

ADVKRVYDIPSADEYPQLTLKGIRMFSQACGVFLPVLWSEIRWWAPCESS
```

Hypholoma sublateritium SQE3

(SEQ ID NO: 183)
```
MSKSRSNYDVIIVGAGIAGCALAHGLSTLSRATPLRIAIVERSLAEPDRIVGELLQPGGVMALQ

RLGMEGCLEGIDAVKVHGYCVVENGTSVHIPYPGVHEGRSFHHGRFIMKLREAARAARGVLVE

ATVTELIPREGGKGIAGVRVARKGKDGEEDTTEALGAALVVVADGCFSNFRAAVMGGAAVKPET

KSHFVGAILKDARLPIPNHGTVALVKGFGPVLLYQISEHDTRMLVDVKAPLFADLKAHILSNIV

PQLPAALHLPIQRALDAERLRRMPNSFLPPVEQGATRGAVLVGDAWNMRHPLTGGGMTVALNDV

VVLRDLLGSVGDLGDWRQVRRALHRWHWDRKPLASTVNILSVALYDLFGADEELQVLRTGCFK

YFERGGDCIDGPVSLLSGIAPSPMLLAYHFFSVAFYSIYVMFAHPQPVAQSKAVGAQNGSAKQV

LAVPGALQYPALCVKGLRVFYTACVVFGPLLWTELRWWTAAEASRGRLLVMSLVPLLLLLGAAN

YGIPGMGLLGVL
```

M1SQE A4

(SEQ ID NO: 203)
```
MAKEEFDICIIGAGMAGATISAYLAPKGIKIALIDRCYKEKKRIVGELLQPGAVLSLEQMGLSH

LLDGFEAQTVKGYALLQGNEKTTIPYPSQHEGIGLHNGRFLQQIRASALENSSVTQIHGKALQL

LENERNEIIGVSYRESITSQIKSIYAPLTITSDGFASNFRAHLSNNQKTVTSYFIGLILKDCEM

PFPKHGHVFLSGPTPFICYPISDNEVRLLIDFPGEQLPRKNLLQEHLDTNVTPYIPECMRSSYA

QAIQEGGFKVMPNHYMAAKPIVRKGAVLLGDALNMRHPLTGGGLTAVFSDIQILSAHLLAMPDF

KNTDLIHEKIEAYYRDRKRANANLNILANALYAVMSNDLLKTAVFRYLQCGGANAQESTALLAG

LNRKHFSLIKQYCFLAVFGACNLLQQSISNIPKALKLLKDAFVIIKPLIKNELS
```

Cucurbitadienol Synthase (CDS), Triterpene Synthase (TTP)
Siraitia grosvenorii CDS (SEQ ID NO: 40)
```
MWRLKVGAESVGENDEKWLKSISNHLGRQVWEFCPDAGTQQQLLQVHKARKAFHDDRFHRKQSS

DLFITIQYGKEVENGGKTAGVKLKEGEEVRKEAVESSLERALSFYSSIQTSDGNWASDLGGPMF

LLPGLVIALYVTGVLNSVLSKHHRQEMCRYVYNHQNEDGGWGLHIEGPSTMFGSALNYVALRLL

GEDANAGAMPKARAWILDHGGATGITSWGKLWLSVLGVYEWSGNNPLPPEFWLFPYFLPFHPGR

MWCHCRMVYLPMSYLYGKRFVGPITPIVLSLRKELYAVPYHEIDWNKSRNTCAKEDLYYPHPKM

QDILWGSLHHVYEPLFTRWPAKRLREKALQTAMQHIHYEDENTRYICLGPVNKVLNLLCCWVED

PYSDAFKLHLQRVHDYLWVAEDGMKMQGYNGSQLWDTAFSIQAIVSTKLVDNYGPTLRKAHDFV

KSSQIQQDCPGDPNVWYRHIHKGAWPFSTRDHGWLISDCTAEGLKAALMLSKLPSETVGESLER

NRLCDAVNVLLSLQNDNGGFASYELTRSYPWLELINPAETFGDIVIDYPYVECTSATMEALTLE

KKLHPGHRTKEIDTAIVRAANFLENMQRTDGSWYGCWGVCFTYAGWFGIKGLVAAGRTYNNCLA

IRKACDFLLSKELPGGGWGESYLSCQNKVYTNLEGNRPHLVNTAWVLMALIEAGQAERDPTPLH

RAARLLINSQLENGDFPQQEIMGVFNKNCMITYAAYRNIFPIWALGEYCHRVLTE
```

Momordica charantia (SEQ ID NO: 41)
```
MWRLKVGAESVGENDEKWVKSISNHLGRQVWEFCPDAGTPQQLLQIEKARKAFQDNRFHRKQTS

DLLVSIQCEKGTTNGARVPGTKLKEGEEVRKEAVKSTLERALSFYSSIQTSDGNWASDLGGPME

LLPGLVIALCVTGALNSVLSKHHRQEMCRYLYNHQNEDGGWGLHIESPSTMFGSALNYVALRLL

GEDADGGEGRAMTKARAWILGHGGATAITSWGKLWLSVLGVYEWSGNNPLPPEFWLLPYFLPFE

PGRMWCHCRMVYLPMSYLYGKRFVGPITPVVLSLRKELYTVPYHEIDWNKSRNTCAKEDLYYPH
```

-continued

SKMQDILWGSIHHMYEPLFTHWPAKRLREKALKTAMQHIHYEDENTRYICLGPVNKVLNMLCCW

VEDPYSEAFKLHLQRVHDYLWVAEDGMKMQGYNGSQLWDTAFSVQAIISTKLVDNYGPTLRKAH

DYVKNSQIQQDCPGEPNVWFRHIHKGAWPFSTRDHGWLISDCTAEGLKASLMLSKLPSETVGEP

LERNRLCDAVNVLLSLQNDNGGFASYELTRSYPWLELINPAETFGDIVIDYPYVECTSATMEAL

ALFKKLHPGHRTKEIDTAIARAADFLENMQRTDGSWYGCWGVCETYAGWFGIKGLVAAGRAYSN

CLAIRKACDFLLSKELPGGGWGESYLSCQNKVYTNLEGNRPHLVNTAWVLMALIEAGQGERDPA

PLHRAARLLINSQLENGDFPQEEIMGVFNKNCMITYAAYRNIFPIWALGEYCHRVLTE

*Cucurbita maxima*
(SEQ ID NO: 42)
MWRLKVGAESVGEKDEKKVKSVSNKLGRQVWEFCADAAADTPHQLLQIQMARNHFHHNRFHRKC

SSDLFLAIQYEKEIAKGAKGGAVKVKEGSEVGKEAVKSTLERALGFYSAVQTSDGNWASDLGGP

MFLLPGLVIALHVTGVLMSVLSKHKRVEMCRYLYNKQNEDGGWGLHIEGTSTMFGSALNYVALR

LLGEDADGGDGGAMTKARAWILERGGATAITSWGKLWLSVLGVYEWSGNNPLPPEFWLLPYSLP

FHPGRMWCHCRMVYLPMSYLYGKRFVGPITPKVLSLRQELYTIPYHEIDWNKSRNTCAKEDLYY

PHPKMQDILWGSIYHVYEPLFTRWPGKRLREKALQAAMKHIHYEDENSRYICLGPVNKVLNMLC

CWVEDPYSDAFKLHLQRVHDYLWVAEDGMRMQGYNGSQLWDTAFSIQAIVATKLVDSYAPTLRK

AHDFVKDSQIQEDCPGDPNVWFRHIHKGAWPFSTRDHGWLISDCTAEGLKASLMLSKLPSTMVG

EPLEKNRLCDAVNVLLSLQNDNGGFASYELTRSYPWLELINPAETFGDIVIDYPYVECTAATME

ALTLFKKLHPGHRTKEIDTAIGKAANFLEKMQRADGSWYGCWGVCFTYAGWFGIKGLVAAGRTY

NSCLAIRKACEFLLSKELPGGGWGESYLSCQNKVYTNLEGNKPHLVNTAWVLMALIBAGQGERD

PAPLHRAARLLMNSQLENGDFVQQEIMGVFNKNCMITYAAYRNIFPIWALGEYCHRVLTE

*Citrullus colocynthis* (CcCDS1)
(SEQ ID NO: 43)
MWRLKVGAESVGEKEEKWLKSISNHLGRQVWEFCADQPTASPNHLQQIDNARKHFRNNRFHRKQ

SSDLFLAIQNEKEIANGTKGGGIKVKEEEDVRKETVKNTVERALSFYSAIQTNDGNWASDLGGP

MFLLPGLVIALYVTGVLNSVLSKHHRQEMCRYLYNHQNEDGGWGLHIEGTSTMFGSALNYVALR

LLGEDADGGEGGAMTKARGWILDRGGATAITSWGKLWLSVLGVYEWSGNNPLPPEFWLLPYCLP

FHPGRMWCHCRMVYLPMSYLYGKRFVGPITPIVLSLRKELYTIPYHEIDWNKSRNTCAKEDLYY

PHPKMQDILWGSIYHLYEPLETRWPGKRLREKALQMAMKHIHYEDENSRYICLGPVNKVLNMLC

CWVEDPYSDAFKFHLQRVPDYLWIAEDGMRMQGYNGSQLWDTAFSVOAIISTKLIDSFGTTLKK

AHDFVKDSQIQQDFPGDPNVWFRHIHKGAWPFSTRDHGWLISDCTAEGLKASLMLSKLPSKIVG

EPLEKSRLCDAVNVLLSLQNENGGFASYELTRSYPWLELINPAETFGDIVIDYPYVECTSATME

ALTLFKKLHPGHRTKEIDTAVAKAANFLENMQRTDGSWYGCWGVCFTYAGWFGIKGLVAAGRTY

STCVAIRKACDFLLSKELPGGGWGESYLSCQNKVYTNLEGNRPHLVNTAWVLMALIEAGQAERD

PAPLHRAARLLINSQLENGDFPQEEIMGVFNKNCMITYAAYRNIFPIWALGEYFHRVLTE

*Citrullus colocynthis* (CcCDS2)
(SEQ ID NO: 44)
MWRLKVGAESVGEKBEKWLKSISNHLGRQVWEFCAHQPTASPNHLQQIDNARNHFRNNRFH -continued

CWVEDPYSDAFKFHLQRVPDYLWVAEDGMRMQGYNGSQLWDTAFSVQAIISTKLIDSFGTTLKK

AHDFVKDSQIQQDCPGDPNVWFRHIHKGAWPFSTRDHGWLISDCTAEGLKASLMLSKLPSKIVG

EPLEKSRLCDAVNVLLSLQNENGGFASYELTRSYPWLELINPAETFGDIVIDYPYVECTSATME

ALTLFKKLHPGRRTKEIDIAVARAANFLENMQRTDGSWYGCWGVCFTYAGWFGIKGLVAAGRTY

NSCVAIRKACDFLLSKELPGGGWGESYLSCQNKVYTNLEGNRPHLVNTAWVLMALIEAGQAERD

PAPLHRAARLLINSQLENGDFPQEEIMGVENKNCMITYAAYRNIFPIWALGEYFHRVLTE

Cucurbita moschata
(SEQ ID NO: 45)
MWRLKVGAESVGEKDEKWVKSVSNHLGRQVWEFCADAAAAATPRQLLQIQNARNHFHRNRFHRK

QSSDLFLAIQYEKEIAEGGKGGAVKVKEEEEVGKEAVKSTLERALSFYSAVQTSDGNWASDLGG

PMFLLPGLVIALYVTGVLNSVLSKHHRVEMCRYLYNHQNEDGGWGLHIEGTSTMFGSALNYVAL

RLLGEDADGGDDGAMTKARAWILERGGATAITSWGKLWLSVLGVYEWSGNNFLPPEFWLLPYSL

PFHPGRMWCHCRMVYLPMSYLYGKRFVGPITPKVLSLRQELYTVPYHEIDWNKSRNTCAKEDLY

YPHPKMQDILWGSIYHVYEPLFTRWPGKRLREKALQTAMKHIHYEDENSRYICLGPVNKVLNML

CCWVEDPYSDAFKLHLQRVHDYLWVAEDGMRMQGYNGSQLWDTAFSIQAIVATKLVDSFAPTLR

KAHDFVKDSQIQEDCPGDPNVWFRHIHKGAWPFSTRDHGWLISDCTAEGLKASLMLSKLPSTMV

GEPLEKNRLCDAVNVLLSLQNDNGGFASYELTRSYPWLELINPAETFGDIVIDYPYVECTAATM

FALTLFKKTHPGHRTKETDTAVGKAANFLEKMQRADGSWYGCWGVCFTYAGWFGTKGTVAAGRT

YNSCLAIRKACEFLLSKELPGGGWGESYLSCQNKVYTNLEGNKPHLVNTAWVLMALIEAGQGER

DPAPLHRAARLLMNSQLENGDFVQQEIMGVFNKNCMITYAAYRNIFPIWALGEYCHRVLTE

Cucumis sativus
(SEQ ID NO: 46)
MWRLKVGKESVGEKEEKWIKSISNHLGRQVWEFCAENDDDDDDEAVIHVVANSSKHLLQQQRRQ

SSFENARKQFRNNRFHRKQSSDLFLTIQYEKEIARNGAKNGGNTKVKEGEDVKKEAVNNTLERA

LSFYSAIQTSDGNWASDLGGPMFLLPGLVIALYVTGVLNSVLSKHHRQEMCRYIYNHQNEDGGW

GLHIEGSSTMFGSALNYVALRLLGEDANGGECGAMTKARSWILERGGATAITSWGKLWLSVLGV

YEWSGNNPLPPEFWLLPYSLPFHPGRMWCHCRMVYLPMSYLYGKRFVGPITHMVLSLRKELYTI

PYHEIDWNRSRNTCAQEDLYYPHPKMQDILWGSIYHVYEPLFNGWPGRRLREKAMKIAMEHIHY

EDENSRYIYLGPVNKVLNMLCCWVEDPYSDAFKFHLQRIPDYLWLAEDGMRMQGYNGSQLWDTA

FSIQAILSTKLIDTFGSTLRKAHHFVKHSQIQEDCPGDPNVWFRHIHKGAWPFSTRDHGWLISD

CTAEGLKASLMLSKLPSKIVGEPLEKNRLCDAVNVLLSLQNENGGFASYELTRSYPWLELINPA

ETFGDIVIDYSYVECTSATMEALALFKKLHPGHRTKEIDAALAKAANFLENMQRTDGSWYGCWG

VCFTYAGWFGIKGLVAAGRTYNNCVAIRKACHFLLSKELPGGGWGESYLSCQNKVYTNLEGNRP

HLVNTAWVLMALIEAGQGERDPAPLHRAARLLINSQLENGDFPQQEIMGVFNKNCMITYAAYRN

IFPIWALGEYSHRVLTE

Cucumis melo
(SEQ ID NO: 47)
MWRLKVGKESVGEKEEKWIKSISNHLGRQVWEFCSGENENDDDEAIAVANNSASKFENARNHFR

NNRFHRKQSSDLFLAIQCEKEIIRNGAKNEGTTKVKEGEDVKKEAVKNTLERALSFYSAVQTSD

GNWASDLGGPMFLLPGLVIALYVTGVLNSVLSKHHRQEMCRYIYNHQNEDGGWGLHIEGSSTMF

GNWASDLGGPMFLLPGLVIALYVTGVLNSVLSKHHRQEMCRYIYNHQNEDGGWGLHIEGSSTMF

NTCAKEDLYYPHPKMQDILWGSIYHVYEPLFSGWPGKRLREKAMKIAMEHIHYEDENSRYICLG

PVNKVLKMLCCWVEDPYSDAFKFHLQRIPDYLWLAEDGMRMQGYKGSQLWDTAFSIQAIISTKL

IDTFGPTLRKAHHFVKHSQIQEDCPGDPNVWFRHIHKGAWPFSTRDHGWLISDCTAEGLKASLM

-continued

LSKLPSKIVGEPLEKNRLCDAVNVLLSLQNENGGFASYELTRSYPWLELINPAETFGDIVIDYS

YVECTSATMEALALFKKLHPGHRTKEIDAAIAKAANFLENMQKTDGSWYGCWGVCFTYAGWFGI

KGLVAAGRTYNNCVAIRKACNFLLSKELPGGGWGESYLSCQNKVYTNLEGNKPHLVNTAWVMMA

LIEAGQGERDPAPLHRAARLLINSQLESGDFPQQEIMGVFNKNCMITYAAYRNIFPIWALGEYS

HRVLDM

*Citrullus lanatus* subsp. *vulgaris*
(SEQ ID NO: 48)
DGMWASDLGGPMFLLPGLVIALYVTGVLNSVLSKHHRQEMCRYLYNHQNEDGGWGLHIEGTSTM

PGSALNYVALRLLGEDADGGEGGAMTKARSWILDRGGATAITSWGKLWLSVLGVYEWSGKNPLP

PEFWLLPYCLPFHPGRMWCHCRMVYLPMSYLYGKRFVGPITPIVLSLRKELYTIPYHEIDWNRS

RNTCAKEDLYYPHPKMQDILWGSIYHLYEPLFTRWPGKRLREKALQMAMKHIHYEDENSRYICL

GPVNKVLNMLCCWVEDPYSDAFKFHLQR7PDYLWVAEDGMRMQGYNGSQLWDTAFSVQAIISTK

LIDSFGTTLKKAHDFVKDSQIQQDCPGDPNVWFRHIHKGAWPFSTRDHGWLISDCTAEGLKASL

MLSKLPSEIVGEPLEKSRLCDAVNVLLSLQNENGGFASYELTRSYPWLELINPAETFGDIVIDY

PYVECTSATMEALTLFKKLHPGRRTKEIDIAVARAANFLEMMQRTDGSWYGCWGVCFTYAGWFG

IKGLVAAGRTYNSCVAIRKACDFLLSKELPGGGWGESYLSCQNKVYTNLEGNRPHLVMTAWVLM

ALIEAGQAERDPAPLHRAARLLINSQLEKGDFPQEEIMGVFNKNCMITYAAYRNIFPIWALGEY

FHRVLTE

*Theobroma cacao*
(SEQ ID NO: 49)
MWRLKIGKESVGDNGAWLRSSNDHVGRQVWEFCPESGTPEELSKVEMARQSFSTDRLLKKHSSD

LLMRIQYAKENQFVTNFPQVKLKEFEDVKEEATLTTLRRALNFYSTIQADDGHWPGDYGGPMFL

LPGLVITLSVTGRLNAVLSKEHQYEMCRYLYNHQNRDGGWGLHIEGPSTMFGTVLNYVTLRLLG

EGFEGGQGAVEKACEWILEHGSATAITSWGKMWLSVLGAYEWSGNNPLPPEVWLCPYFLPIHPG

RMWCHCRMVYLPMSYLYGKRFVGPIITPILSLRKELYAVPYHEVDWNKARNTCAKEDLYYPHPL

VQDILWASLHYLYEPIFTRWPGKSLREKALRTVMQHIEYEGENTRYICIGPVNKVLNMLSCSWE

DPYSESFKLHLPRILDYLWIAEDGMKMQGYNGSQLWDTAFAVQAIISTGLADEYGPILRKAHDF

IKYSQVLEDCPGDLNFWYRHISKGAWPFSTVDHGWPISDCTSEGLKAVLLLSTLPSESVGEPLH

MMRLYDAVMVILSLQNVDGGFPTYELTRSYQWLELIMPAETFGDIVIDYPYVECTSAAIQALIS

FKKLFPEHRMEEIENCIGRAVEFIEKIQAADGSWYGSWGVCFTYAGWFGIKGLSAAGRTYNNSS

NIRKACDFLLSKELATGGWGESYLSCQNKVYTNLEGARPHIVNTSWALLALIEAGQAERDPTPL

HRAARILINSQMEDGDFPQEEIMGVFNKNCMISYSAYRNIFPIWALGEYTCRVLRAP

*Ziziphus jujube*
(SEQ ID NO: 50)
MWKLKIGAETVGEGGSDGWLRSVNSHLGRQVWEFHPELGTPEELRQIQDARDAFFNHRFHKQHS

SDLLMRIQFAKENPCVANPPQVKVKDTDEVTEESVTTTLRRAINFYSTIQAHDGHWAGDYGGPM

FLLPGLVITLSVTGALNAVLSKEHQCEMCRYIYNRQNEDGGWGLHIEGPSTMFGTVLNYVSLRL

LGEGAEDGLGTIENARKWILDHGGATAITSWGKMWLSVLGVYEWSGNNPLPPEVWLCPYTLPFK

PGRMWCHCRMVYLPMSYLYGKRFVGPITPTIRSLRKELYTAPYHEIDWNRARNECAKEDLYYPH

PLVQDVLWASLHYVYEPIFMRWPAKKLREKALSTVMQHIHYEDENTRYICIGPVNKVLMMLCCW

VEDPMSEAFKLHLPRISDYLWIAEDGMKMQGYNGSQLWDTAFAVQAIVSTDLAEEYGPTIRKAH

EYIKNSQVLEDCPGDLNFWYRHISKGAWPFSTADHGWPISDCTAEGLKAVLLLSQLSSETVGDS

LDVKRLFNAVNVILSLQNGDGGFATYELTRSYQWLELINPAETFGDIVIDYPYVECTSAALEAL

-continued

TLFKKSYPGHRREEVENCITNAAMFIENIQAKDGSWYGSWGVCFTYAGWFGIKGLVASGRTYEN

CPSIRKACDFLLSKELPSGGWGESYLSCQNKVYTNLKDNKPHIVNTAWAMLALIVARQAERDPM

PLHRAARILIKSQMHDGDFPQEEIMGVFNKNCMISYAAYRNIFPIWALGEYRLHVLRSL

*Prunus avium*

(SEQ ID NO: 51)

MWKLKIGAETVGEGGYQWLKSVNNHLGRQVWEFNPELGSPEELQRIEDARKAFWDNRFERRHSS

DLLMRIQFEKENQCVTNLPQLKVKYEEEVTEEVVKTTLRRAISFYSTIQAHDGHWPGDYGGPME

LLPGLVITLSITGALNDVLSKEHQHEMCRYLYNHQNKDGGWGLHIEGPSTMFGTALNYVTLRLF

GEGADDCEGAMELARKWILDHGGVTKITSWGKMWLSVLCTYEWSGNNPLPPEVWLCPYSLPFHP

GRMWCHCRMVYLPMSYLYGKRFVGPITPTIRSLRKELYGVPYHEVDWNQARNLCAKEDLYYPHP

MVQDILWASLHYVYEPVFTRWPAKKLRENALQTVMQHIHYEDENTRYICIGPVNKVLNMLCCWA

EDPNSDAFKLHLPRIPDYLWVAEDGMKMQGYNGSQSWDTSFAVQAIISTNLAEEFCPTLRKAHE

YIKDSQVLEDCPGDLNFWYRHISKGAWPFSTADHGWPISDCTAEGLKAVLLLSKLPTGTVGESL

DMKQLYDAVNVMLSLQNEDGGFATYELTRSYQWLELINPAETFGDIVIDYPYVECTSAAIQALT

MFRKLYPGHRREEIESCIARAAKFIEKIQATDGSWYGSWGVCFTYAGWFGIKGLAAAGRTYKDC

SSIRKACDFLLSKELPSGGWGESYLSCQNKVYTNLKDNRPHIVHTAWAMLALIGAGQAKRDPTP

LHRAARVLINSQMENGDFPQ

*Brassica napus*

(SEQ ID NO: 52)

MWKLKIAEGGSPWLRTTNNH7GRQFWEFDPNLGTPEELAAVEEARKSFRENRFAKKHSSDLLMR

LQFSRESLSRPVLPQVNIKDSDDVTEKMVETTLKRGVDFYSTIQASDGHNAGDYGGPMFLLPGL

IITLSITGALNTVLSEQHKAEMRRYLHNHQNEDGGWGLHIEGPSTMFGSVLNYVTLRLLGEGPN

DGDGAMEKGRDWILRHGGATNITSWGKMWLSVLGAFEWSGMNPLPPEIWLLPYILPIHPGRMWC

HCBMVYLPMSYLYGKRFVGPITSTVLSLRKELFTVPYHEVDWNEARNLCAKEDLYYPHPLVQDI

LWASLHKIVEPVLTRWPGSNLREKALRTTLEHIHYEDENTRYICIGPVNKVLNMLCCWVEDPNS

EAFKLHLPRIHDYLWVAEDGIKMQGYNGSQLWDTSFAVQAVLATNFREEYGPVLKKAHSYVKNS

QVSEDCPGDLSYWYRHISKGAWPFSTADHGWPISDCTAEGLKAALLLSKVPKEIVGEPVDTKRL

YDAVNVIISLQNADGGFATYELTRSYPWLELINPAETFGDIVIDYPYVECTSAAIQALIAFRKL

YPGHRKKEVDECIEKAVKFIESIQESDGSWYGSWAVCFTYGTWEGVKGLEAAGKTLKNSPTVAK

ACEFLLSKQLPSGGWGESYLSCQDKVYSNLDGNRSHVVNTAWALLSLIGAGQVEVDQKPLHRAA

RYLINAQMESGDFPQQEIMGVFNRNCMITYAAYRNIFPIWALGEYRSKVLLQQGE

*Spinacia oleracea*

(SEQ ID NO: 53)

MQFAQENSSNVVLPQVKVKDEDEITEETVATTLRRALSYQSTIQAHDGHWPGDYGGPMFLMPGL

VIALSVTGALNAVLSKEHQKEMCRYLYNHQNKDGGWGLHIEGHSTMFGTVLTYVTLRLLGEGVD

DGDGAMERGRKWTLEHGSATATTSWGKMWLSVLGVFEWAGNNPMPPETWLLPYILPVHPGRMWC

HCRMVYLPMSYLYGKREVGPITPTVLSLRRELFDVPYHEIDWDRARNECAKEDLYYPHPLVQDI

LWASLHKAVEPILMRWPGKKLREKALSTVMEHIHYEDENTRYICIGPVNKVLNMLCCWVEDPNS

EAFKLHLPRIPDFLWVAEDGMKMQGYNGSQLWDTTEMVQAILATNLGEEYGGTLRKAHNFIKDS

QVREDCPGDLSYWYRHISKGAWPFSTADHGWPISDCTAEGLKAALLLSKVPSDIVGEPLEVKRL

YDSVNVLLSLQNGDGGFATYELTRSYPWLELINPAETFGDIVIDYPYVECTSAAIQALVSFKRL

YPGHRREEIENCIKKAAKFIEDIQAADGSWYGSWAVCFTYATWFGIKGLVAAGKNYDNCPAIRK

ACDFLLSKQLSNGGWGESYLSCQNKVYSNIEGNKAHVVNTGWAMLALIGAGQAKRDPMPLHRAA

KVLINSQMPNGDFPQQEIMGVFNRNCMITYAAYRNIFPTWALGEYRTQVLQK

-continued

Trigonella foenum-graecum
(SEQ ID NO: 54)
MWKLKIAEGGSPWLRTTNNHVGRQIWEFDPNLGTPEQIREVEEARENFWKNRFEQKHSSDLLMR

IQLAKENPMGEVIPKVRVKDVEDVNEESVTTTLRRALNFYSTLQSRDGHWPGDYGGPMFLMPGL

VIALSITGALNAVLTDEHQKEMRRYLYNHQNKDGGWGLHIEGPSTMFGSVLCYVTLRLLGEGPN

DGEGEMEKARDWILEHGGATYITSWGKMWLSVLGVFEWSGNNPLPPEIWLLPYMLPIHPGRMWC

HCRMVYLPMSYLYGKRFVGPITPTVLSLRRELFDVPYHEIDWDRARNECAKEDLYYPHPLVQDI

LWASLHKFVEPIFMNWPGKKLREKAVETVMEHVHYEDENTRYICIGPVNKVLNMLCCWVEDPNS

EAFKLHLPRIPDFLWIAEDGMKMQGYNGSQLWDTTEMVQAILATNLGEEYGGTLRKAHNFIKDS

QVLEDCPGDLSKWYRHISKGAWPFSTADHGWPISDCTAEGLKAVLLLSKIGPEIVGEPLDAKGE

YDAVNVIISLQNEDGGLATYELTRSYKWLEIINPAETFGDIVIDYTYVECTSAAIQALSTFRKL

YPGHRREEIQHCIEKAAAFIEKIQASDGSWYGSWGVCFTYGTWFGVKGLIAAGKSFSNCLSIRK

ACDFLLSKQLPSGCWGESYLSCQNKVYSNLESNRSHVVNTGWAMLALIEAEQAKRDPTPLHHAA

VCLINSQMENGDFPQEEIMGVFNKNCMITYAAYRNIFPIWALGEYRRHVLQA

Ricinus communis
(SEQ ID NO: 55)
MWKLRIAEGSGNPWLRTTNDHIGRQVWEFDSSKIGSPEELSQIENARQNFTKNRFIHKHSSDLL

MRIQFSKENPICEVLPQVKVKESEQVTEEKVKITLRRALNYYSSIQADDGHWPGDYGGPMELMP

GLIIALSITGALNAILSEEHKREMCRYLYNHQNRDGGWGLHIEGPSTMFGSVLCYVSLRLLGEG

PNEGEGAVERGRNWILKHGGATAITSWGKMWLSVLGAYEWSGNNPLPPEMWLLPYILPVHPGRM

NCHCRMVYLPMSYLYGKRFVGPITPTVLSLRKELYTVPYHEIDWNQARNQCAKEDLYYPHPMLQ

DVLWATLHKFVEPILMHWPGKRLREKAIQTAIEHIHYEDENTRYICIGPVNKVLNMLCCWVEDP

NSEAFKLHLPRLYDYLWLAEDGMKMQGYNGSQLWDTAFAVQAIVSTNLIEEYGPTLKKAHSFTK

KMQVLENCPGDLNFWYRHISKGAWPFSTADHGWPISDCTAEGIKALMLLSKIPSEIVGEGLNAN

RLYDAVNVVLSLQNGDGGFPTYELSRSYSWLEFINPAETFGDIVIDYPYVECTSAAIQALTSFR

KSYPEHQREEIECCIKKAAKFMEKIQISDGSWYGSWGVCFTYGTWFGIKGLVAAGKSFGNCSSI

RKACDFLLSKQCPSGGWGESYLSCQKKVYSNLEGDRSHVVNTAWAMLSLIDAGQAERDPTPLHR

AARYLINAQMENGDFPQQEIMGVFNRNCMITYAAYRDIFPIWALGEYRCRVLKAS

Pisum sativum cycloartenol synthase (PsCAS_mut)
(SEQ ID NO: 191)
MAWKLKVAEGGTPWLRTLNNHVGRQVWEFDPHSGSPQDLDDIETARRNFHDNRFTHKHSDDLLM

RLQFAKENPMNEVLPKVKVKDVEDVTEEAVATTLRRGLNFYSTIQSHDGHWPGDLGGPMFLMPG

LVITLSVTGALNAVLTDEHRKEMRRYLYNHQNKDGGWGLHIEGPSTMFGSVLCYVTLRLLGEGP

NDGEGDMERGRDWILEHGGATYITSWGKMWLSVLGVFEWSGNNPMPPEIWLLPYALPVHPGRMW

CHCRMVYLPMSYLYGKRFVGPITPTVLSLRKELPTVPYHDIDWNQARNLCAKEDLYYPHPLVQD

ILWATLHKFVEPVFMNWPGKKLREKAIKTAIEHIHYEDENTRYICIGPVNKVLNMLCCWVEDPN

SEAFKLHLPRIYDYLWVAEDGMKMQGYNGSQLWDTAFAAQALISTNLIDEFGPTLKKAHAFIKN

SQVSEDCPGDLSKWYRHISKGAWPFSTADHGWPISDCTAEGLKAVLLLSKIAPEIVGEPLDSKR

LYDAVNVILSLQNENGGLATYELTRSYTWLEIINPAETFGDIVIDCPYVECTSAAIQALATFGK

-continued

LYPGHRREEIQCCIEKAVAFIEKIQASDGSWYGSWGVCFTYGTWFGIKGLIAAGKNFSNCLSIR

KACEFLLSKQLPSGGWAESYLSCQNKVYSNLEGNRSHVVNTGWAMLALIEAEQAKRDPTPLHRA

AVCLINSQLENGDFPQEEIMGVFNKNCMITYAAYRCIFPIWALGEYRRVLQAC

*Cucurbita pepo* subsp. *pepo* cycloartenol synthase (CpCAS mut)
(SEQ ID NO: 192)

MAWQLKIGADTVPSDPSNAGGWLSTLNNHVGRQVWHFHPELGSPEDLQQIQQARQHFSDHRFEK

KHSADLLMRMQFAKENSSFVNLPQVKVKDKEDVTEEAVTRTLRRAINFYSTIQADDGHWPGDLG

GPMFLIPGLVITLSITGALNAVLSTEHQREICRYLYNHQNKDGGWGLHIEGPSTMFGSVLNYVT

LRLLGEEAEDGQGAVDKARKWILDHGGAAAITSWGKMWLSVLGVYEWAGNNPLPPELWLLPYLL

PCHPGRMWCHCRMVYLPMCYLYGKRFVGPITPIIRSLRKELYLVPYHEVDWNKARNQCAKEDLY

YPHPLVQDILWATLHHVYEPLFMHWPAKRLREKALQSVMQHIHYEDENTRYICIGPVNKVLNML

CCWAEDPHSEAFKLHIPRIYDYLWIAEDGMKMQGYNGSQLWDTAFAVQAIISTELAEEYETTLR

KAHKYIKDSQVLEDCPGDLQSWYRHISKGAWPFSTADHGWPISDCTAEGLKAVLLLSKLPSEIV

GKSIDEQQLYNAVNVILSLQNTDGGFATYELTRSYRWLELMNPAETFGDIVIDYPYVECSSAAI

QALAAFKKLYPGHRRDEIDNCIAEAADFIESIQATDGSWYGSWGVCFTYGGWFGIRGLVAAGRR

YNNCSSLRKACDFLLSKELAAGGWGESYLSCQNKVYTNIKDDRPHIVNTGWAMLSLIDAGQSER

DPTPLHRAARVLINSQMEDGDFPQEEIMGVFNKNCMISYSAYRNIFPTWALGEYRSRVLKPLK

*Zostera marina* cycloartenol synthase (ZmCAS mut)
(SEQ ID NO: 193)

MAWKLKVAEGRDARLRTINGHVGROIWEFDPDLGTDNERAEVEAVREKFRNNRFEKKHSSDLLM

RLQLAKENPVSSYLTQVKLEENEDITEEAVTMTLRRALNFHSSIQSFDGHWAGDLGGPMFLMPG

LVISLYITGVLNTVLSSEHQREMCRYLYNHQNEDGGWGLHIEGPSTVFGSTLTYITLRLLGENV

EDGDGAMEKGRKWILDHGGATYITSWGKMWLSVLGVFDWSGNNPLPPEMWLLPYFLPVHPGRMW

CHCRMVYLPMSYLYGKRFVGKITPLVLSLRNEIYTVSYNQIDWNKARNLCAKEDLYYPHPMVQD

LLWATLHKEVEPLLMHWPGTLLREKALNTTMQHLHYEDESTRYICIGPVNKVLNMLCCWVDDPD

SEAFKLHLPRISDYLWIAEDGMKCQGYNGSQLWDTAFAVQAYIATNLSDEFGPVLTKAHEYIKN

SQVPDDCSGDLSFWYRHISKGAWPFSTGDHGWPISDCTAEGLKASLLLSRISPEVVGKPLNAKR

FYDAVNVILSLMNSDGSFATYELTRSYTWLEMINPAETFGDIVIDYPYVECTSAAIQSLVAFTK

LYPGHRREEIDECITKAAKFIESIQKKDGSWYGSWAVCFTYGLWFGIKGLIAAGKTYKNSSAIR

KACEFLLSKQLASGGWGESYLSCQDKVYTNLEGNRAHAVNTGWAMLSLIDAGQAERDPSPLHRA

ARVLINSQMGNGDFPQEEIMGVFNRNCMISYSAYRNIFPIWALGEYRCKVLASKGHE

*Artemisia annua* (AaCASmut)
(SEQ ID NO: 219)

MAWKLKIAEGGDPWLRTTNDHIGRQIWEFDPTLGSVEELAEIEKLRKTFRDNRFEKKHSADLLM

RSQFAKENSVSVFPPKVNIKDVEDITEDKVTNVLRRAIGFHSTLQADDGHWPGDLGGPMFLLPG

LVITLSITGALNAVLSKEHKREMCRYLYNHQNIDGGWGLHIEGHSTMFGSALNYVTLRLLGEGA

NDGEGAMEKGRKWILDHGGATAITSWGKFWLSVLGVFEWPGNNPLPPEMWLLPYFLPVHPGRMW

CHCRMVYLPMSYLYGKRFVGPITSTVLALRKELFTVPYHDIDWNEARNLCAKEDLYYPHPLIQD

VLWATLDKFVEPVLMSWPGKKLREKALRTAMEHIHYEDENTRYICIGPVNKVLNMLCCWVEDPN

SEAFKLHLPRIQDYLWIAEDGMKMQGYNGSQLWDAAFTVQAIMSTNLIEEFGPTLKKGHIFIKK

SQVLDNCYGDLDYWYRHISKGAWPFSTADHGWPISDCTAEGLKAALLLSKLPSEIVDEPLDAKR

FYDAVNVILSLMNADGSFATYELTRSYSWLELINPAETFGDIVIDYPYVECTSAAIQALVAFKR

LYPGHRRDEVQGCIDKAAAFLEKIQEADGSWYGSWAVCFTYGTWFGVKGLVAAGKNYSNCSSIR

KACNFLLSKQLASGGWGESYLSCVDKVYTNLEGNRSHVVNTGWAMLALIDAEQAKRDPTPLHRA

ARVL.INSQMENGEFPQQEIMGVFNRNCMITYAAYRNIFPIWALGEYRCRVLKVET

*Citrullus colocynthis* (CcCDS2)

(SEQ ID NO: 220)

MAWRLKVGAESVGEKEEKWLKSISNHLGRQVWEFCAHQPTASPNHLQQIDNARNHFRNNRFHRK

QSSDLELAIQNEKEIANVTKGGGIKVKEEEDVRKETVKNTVERALSFYSAIQTNDGNWASDLGG

PMFLLPGLVIALYVTGVLNSVLSKHHRQEMCRYLYNHQNEDGGWGLHIEGTSTMFGSALNYVAL

RLLGEDADGGEGGAMTKARSWILDRGGATAITSWGKLWLSVLGVYEWSGNNPLPPEFWLLPYCL

PFHPGRMWCHCRMVYLPMSYLYGKRFVGPITPIVLSLRKELYTIPYHEIDWNRSRNTCAKEDLY

YPHPKMQDILWGSIYHLYEPLETRWPGKRLREKALQMAMKHIHYBDENSRYICLGPVNKVLNML

CCWVEDPYSDAFKFHLQRVPDYLWVAEDGMRMQGYNGSQLWDTAFSVQAIISTKLIDSFGTTLK

KAHDFVKDSQIQQDCPGDPNVWFRHIHKGAWPFSTRDHGWLISDCTAEGLKASLMLSKLPSKIV

GEPLEKSRLCDAVNVLLSLQNENGGFASYELTRSYPWLELINPAETFGDIVIDYPYVECTSATM

EALTLFKKLHPGHRTKEIDIAVARAANFLENMQRTDGSwYGCWGVCFTYAGWEG1KGLVAAGRT

YNSCVAIRKACDFLLSKELPGGGWGESYLSCQNKVYTNLEGNRPHLVNTAWVLMALIEAGQAER

DPAPLHRAARLLINSQLENGDFPQEEIMGVFNKNCMITYAAYRNIFPIWALGEYFHRVLTE

Epoxide Hydrolase
*Siraitia grosvenorii* EPH1 (SgEPH1)

(SEQ ID NO: 56)

MEKIEHSTIATNGINMHVASAGSGPAVLFLHGFPELWYSWRHQLLYLSSLGYRAIAPDLRGFGD

TDAPPSPSSYTAHHIVGDLVGLLDQLGVDQVFLVGDWGAMMAWYFCLFRPDRVKALVNLSVHFT

PRNPAISPLDGFRLMLGDDFYVCKFQEPGVAEADFGSVDTATMFKKFLTMRDPRPPIIPNGFRS

LATPEALPSWLTEEDIDYFAAKFAKTGFTGGFNYYRAIDLTWELTAPWSGSEIKVPTKFIVGDL

DLVYHFPGVKEYIHGGGFKKDVPFLEEVVVMEGAAHFINQEKADEINSLIYDFIKQF

*Siraitia grosvenorii* EPH2 (SgEPH2)

(SEQ ID NO: 57)

MEKIEHTTISTNGINMHVASIGSGPAVLFLHGFPELWYSWRHQLLELSSMGYRAIAPDLRGFGD

TDAPPSPSSYTAHHIVGDLVGLLDQLGIDQVFLVGHDWGAMMAWYFCLFRPDRVKALVNLSVHE

LRRHPSIKFVDGFRALLGDDFYFCQFQEPGVAEADFGSVDVATMLKKFLTMRDPRPPMIPKEKG

FRALETPDPLPAWLTEEDIDYFAGKFRKTCFTGGFNYYRAFNLTWELTAPWSGSEIKVAAKFIV

GDLDLVYHFPGAKEYIHGGGFKKDVPLLEEVVVVDGAAHFINQERPAEISSLIYDFIKKE

*Siraitia grosvenorii* EPH3 (SgEPH3)

(SEQ ID NO: 58)

MDQIEHITINTNGIKMHIASVGTGPVVLLLHGFPELWYSWRHQLLYLSSVGYRAIAPDLRGYGD

TDSPASPTSYTALHIVGDLVGALDELGIEKVFLVGHDWGAIIAWYFCLFRPDRIKALVNLSVQE

IPRNPAIPFIEGFRTAFGDDFYMCRFQVPGEAEEDFASIDTAQLFKTSLCNRSSAPPCLPKEIG

FRAIPPPENLPSWLTEEDINYYAAKFKQTGFTGALNYYRAFDLTWELTAPWTGAQIQVPVKFIV

GDSDLTYHFPGAKBYIHNGGFKKDVPLLEEVVVVKDACHFINQERPQEINAHIHDFINKE

*Momordica charantia*

(SEQ ID NO: 59)

MEKIEHSTIAANGITIHVASVGSGPAVLLLHGFPELWYSWRHQLLFLASKGYRAIAPDLRGFGD

SDAPPSPSSYTPLHIVGDLVALLDHLGIDLVFLVGHDWGAMMAWHFCLLRPDRVKALVNLSVHE

MPRNPAMSPLDGMRLLLGDDFYVCRFQEPGAAEEADFGSVDTATMMKKFLTMRDPRPPIIPNGFR

-continued

SLETPQALPPWLTEEDIDYFAAKFAKTGFTGGFNYYRAIGRTWELTAPWTGSKIKVPAKFIVGD

LDMVYHLPDAKEYIHGGGFKEDVPLLEEVVVIEGAAHFINQEKPDEISSLIYDFIKKF

Cucurbita moschata
(SEQ ID NO: 60)
MEKIEHSTIATNGINMHVASIGSGPPVLFLHGFPELWYSWRHQLLFLASKGFRAIAPDLRGFGD

SDVPPSPSSYTPFHIIGDLIGLLDHLGIEQVFLVGHDWGAMMAWYFCLFRPDRVKALVNLSVHY

NPRNPAISPLSRTRQFLGDDFYICKFQTPGVAEADFGSVDTATMMKKFLTIRDPSPPIIPNGFK

TLKTPETLPSWLTEEDIDYFASKFTKTGFTGGFNYYRAIEQTWELTGPWSGAKIKVPTKYVVGD

VDMVYHLPGAKQYIHGGGFKKDVPLLEEVVVMEGAAHFINQEKADEISAHIYDFIIKF

Cucurbita maxima
(SEQ ID NO: 61)
MENIEHTIVPTNGINMHIASIGSGPAVLFLHGFPELWYSWRHQLLFLASNGFRAIAPDLRGFGD

TDVPPSPSSYTAHHIVGDLIGLLDHLGIDRVFLVGHDWGAMMAWYFCLFRPDRVRALVNLSVHY

LHRHPSIKFVDGFRAFLGDDFYFCQFQEPGVAEADFGSVDTATMLKKELTMRDPRPPMIPKEKG

FRALETPDPLPSWLTEEDVDYFASKFSKTGFTGGFNYYRAFDLSWELTAPWSGSQVKVPAKFIV

GDLDLVYHFPGAKEYIHGGREKEDVPFLEEVVVIEGAAHFINQERADEISSLIYEEINKE

Prunus persica
(SEQ ID NO: 62)
MEKIEHTTVSTNGINMHIASIGTGPVVLFLHGFPELWYSWRHQLLSLSSLGYRCIAPDLRGFGD

TDAPPSPASYSALHIVGDLIGLLDHLGIDQVFLVGHDWGAVIAWWFCLFRPDRVKALVNMSVAF

SPRNPKRKPVDGFRALFGDDYYICRFQEPCEIEKEFAGYDTTSIMKKFLTGRSPKPPCLPKELC

LRAWKTPETLPPWLSEEDLNYFASKFSKTGFVGGLNYYRALNLTWELTGPWTGLQVKVPVKFIV

GDLDITYHIPGVKNYIHNGGFKRDVPFLQEVVVIEDGAHFINQERPDEISRHVYDFIQKF

Morus notabilis
(SEQ ID NO: 63)
MEKIEHSTVHTNGINMHVASVGTGPAILFLHGFPELWYSWRHQMISLSSLGYRCIAPDLRGYGD

TDAPPSPTSYTSLHIVGDLVGLIDHLVIEKLFLVGHDWGAMIAWYFCLFRPDRIKALVNLSVPE

FPRNPKINFVDGFRAELGDDFYICRFQEPGESEADFSSDTVAVFRRILANRDPKPPLIPKEIGF

RGVYEDPVALPSWLTEDDINHFANKFNETGFTGGLNYYRALNLTWELTAAWTGARVQVPTKFIM

GDLDLVYYFPGMKEYILNGGFKRDVPLLQELVIIEGAAHFINQEKPDEISSHIHHFIQKF

Ricinus communis
(SEQ ID NO: 64)
MEKIEHTTVATNGINMHVAAIGTGPEILFLHGFPELWYSWRHQLLSLSSRGYRCIAPDLRGYGD

TDAPESLTGYTALHIVGDLIGLLDSMGIEQVFLVGHDWGAMMAWYLCMFRPDRIKALVNTSVAY

MSRNPQLKSLELFRTVYGDDYYVCRFQEPGGAEEDFAQVDTAKLIRSVFTSRDPNPPIVPKEIG

FRSLPDPPSLPSWLSEEDVNYYADKFNKKCFTGGLNYYRNIDQNWELTAPWDGLQIKVPVKFVI

GDLDLTYHFPGIKDYIHNGGFKQVVPLLQEVVVMEGVAHFINQEKPEEISEHIYDFIKKE

Citrus unshiu
(SEQ ID NO: 65)
MEKIEHTTVGTNGINMHVASIGTGPVVLFIHGFPELWYSWRNQLLYLSSRGYRAIAPDLRGYGD

TDAPPSVTSYTALHLVGDLIGLLDKLGIHQVFLVGHDWGALIAWYFCLFRPDRVKALVNMSVPF

PPRNPAVRPLNNFRAVYGDDYYICRFQEPGEIEEEFAQIDTARLMKKFLCLRIAKPLCIPKDTG

LSTVPDPSALPSWLSEEDVNYYASKFNQKGFTGPVNYYRCSDLNWELMAPWTGVQLEVPVKFIV

GDQDLVYNNKGMKEYIHNGGFKKYVPYLQEVVVMEGVAHFINQEKAEEVGAHIYEFIKKF

Hevea brasiliensis
(SEQ ID NO: 66)
MEKIEHITVFTNGINMHIASIGTGPEILFLHGFPELWYSWRHQLLSLSSLGYRCIAPDLRGYGD

TDAPQSVNQYTVLHIVGDLVGLLDSLGIQQVFLVGHDWGAFIAWYFCIFRPDRIKALVNTSVAF

-continued

```
MPRNPQVKPLDGLRSMFGDDYYICQFQKPGKAEEDFAQVNTAKLIKLLFTSRDPRPPHFLKEVG

LKALQDPPSQQSWLTEEDVNFYAAKFNQKGFRGGLNYYQNINMNWELAAAWTGVQIKVPVKFII

GDLDLTYHFPGIKEYIHNGGFKKDVPLLQDVWMEGVAHFLNQEKPEEVSKHIYDFIKKF

Handroanthus impetiginosus
                                                         (SEQ ID NO: 67)
MDKIQHKIIQTNGININHVAEIGDGPAVLFLHGFPELWYSWRHQMLFLSSRGYRAIAPDLRGYGD

SDAPPCATSYTAEHLLGDLVGLLDAMGLDRVFLVGHDWGAVMAWYPOLLKPDRLKALVNLSVVF

QPRNPKRKPVESMRAKLGDDYYICRFQEPGEAEEEFARVDTARLIKKLLTTRNPAPPRLPKEVG

FGCLPHKPITMPSWLSEEDVQYYAAKENQKGETGGLNYYRAMDLSWELAAPWTGVQIKVPVKFI

VGDLDITYNTPGVKEYIHKGRFKQHVPFLQELVILEGVAHFLNQEKPDEINQHIYDFIHKF

Camelina sativa
                                                         (SEQ ID NO: 68)
MEKIEHTTVSTNGINMHVASIGSGPVILFLHGFPDLWYSWRHQLLSFAALGYRAIAPDLRGYGD

SDAPPSPESYTILHIVGDLVGLLDSLGVDRVFLVGHDWGAIVAWWLCMIRPDRVKALVNTSVVE

NPRNPSVKPVDKFRDLFGDDYYVCRFQETGEIEEDFAQVDTKKLITRFFVSRNPRPPCIPKSVG

FRGLPDPPSLPAWLTEQDVSFYGDKFSQKGFTGGLNYYRAMNLSWELTAPWAGLQIKVPVKFIV

GDLDITYNIPGTKEYIHGGGLKKHVPFLQEVWMEGVGHFLQQEKPDEVTDHIYGFFEKFRTRE

TSSL

Coffea canephora
                                                         (SEQ ID NO: 69)
MDKIQHRQVPVNGINLHVAEIGDGPAILFLHGFPELWYSWRHQLLSLSAKGYRALAPDLRGYGD

SDAPPSPSNYTALHIVGDLVGLLDSLGLDRVFLVGHDWGAVMAWYFCLLRPDRIKALVNMSVVF

TPRNPKRKPLEAMRARFGDDYYICRFQEPGEAEEEFARVDTARIIKKFLTSRRPGPLCVPKEVG

FGGSPHNPIQLPSWLSEDDVNYFASKFSQKGFTGGLNYYRAMDLNWELTAPWTGLQIKVPVKFI

VGDLDVTFTTPGVKEYIQKGGFKRDVPFLQELVVMEGVAHFVNQEKPEEVSAHIYDFIQKF

Punica granatum
                                                         (SEQ ID NO: 70)
MEKIQHTTVRTNGINMHVATAGSGPDSILEVHGFPELWYTWRHQMVSLAALGYRTIAPDLRGYG

DTDAPPSHESYTAFHIVGDLVGLLDSMGIEKVFLVGHDWGAAIAWYFCLFRPDRIKALVNMSVV

FHPRNPNRKPVDGLRAILGDDYYICRFQAPGEIEEDFARADTANIIKFFLVSRNPRPPQIPKEG

FSCLANSRQMDLPSWLSEEDINYYASKFSEKCFTGGLNYYRVMNLNWELTAPFTCLQIKVPAKE

MVGDLDITYNTPGTKEFIHNGGLKKHVPFLQEVVVMEGVAHFINQEKPEEVTAHIYDFIKKE

Arabidopsis lyrata subsp. lyrata
                                                         (SEQ ID NO: 71)
MEKIEHTTVSTNGINMHVASIGSGPVILFLHGFPDLWYSWRHQLLSFAALGYRAIAPDLRGYGD

SDAPPSRESYTILHIVGDLVGLLNSLGVDRVFLVGHDWGAIVAWWLCMIRPDRVNALVNTSVVF

NPRNPSVKPVDAFRALFGDDYYICRFQEPGEIEEDFAQVDTKKLITRFFISRNPRPPCIPKSVG

FRGLPDPPSLPAWLTEEDVSFYGDKFSQKGFTGGLNYYRALNLSWELTAPWAGLQIKVPVKFIV

GDLDITYNIPGTKEYIHEGGLKKHVPFLQEVVVLEGVGHFLHQEKPDEITDHIYGFFKKFRTRE

TASL

Rhinolophus sinicus
                                                         (SEQ ID NO: 72)
MDKIEHTTVSTNGINMHVASIGSGPVILFLHGFPDLWYSWRHQLLSFAGLGYRAIAPDLRGYGD

SDSPPSHESYTILHIVGDLVGLLDSLGVDRVFLVGHDWGAVVAWWLCMIRPDRVNALVNTSVVF

NPRNPSVKPVDAFKALFGEDYYVCRFQEPGEIEEDFAQVDTKKLINRFFTSRNPRPPCIPKTLG
```

```
FRGLPDPPALPAWLTEQDVSFYADKFSQKGFTGGLNYYRAMNLSWELTAPWAGLQIKVPVKFIV

GDLDITYNIPGTKEYIHEGGLKKHVPFLQEVVVMEGVGHFLHQEKPDEVTDHIYGFFKKE
```

Gossypium raimondii (GrEPH)
                                                        (SEQ ID NO: 184)
```
MAEKIEHTTVTTNGIKMHVASIGSGPIILFLHGFPELWYTWRHQLLSLSSLGYRCVAPDLRGYG

DSDAPPSPESYTVFHIVGDLVGLLDALGVDKVFLVGHDWGAMIAWNFCLFRPDRIKALVNLSIP

YHPRNPKVKTVDGYRALFGDDFYICRFQVPGEAEAHFAQMDTAKVMKKFLTTRDPNPPCIPRET

GLKALPDPPALPSWLSEDEINYFATKFSQKGFTGGLNYYRAMNLNWELMAPWTGLQIQVPVKFI

VGDLDITYHIPGVKEYLQNGGFKKNVPFLQELVVMEGVAHFINQEKPQEISMHIYDFIKKF
```

Gossypium hirsutum (GhEPH)
                                                        (SEQ ID NO: 185)
```
MAEKIEHTTVTTNGIKMHVASIGSGPIILFLHGFPELWYTWRRQLLSLSSLGYRCVAPDLRGYG

DSDAPPSPESYTVFHVVGDLVGLLDALGVDKVFLVGHDWGAMIAWNFCLFRPDRIKALVNLSVP

YHPRNPKVKTVDGYRALFGDDFYICRFQVPGEAEAHFAQMDTAKVLKKFLTTRDPNPPCIPKET

GLKALPDPPALPSWLSEDEINYFATKFNQKGFTGGLNYYRAMNLNWELMAPWTGLQIQVPVKFI

VGDLDITYHIPGVKEYLQNGGFKKNVPFLQELVVMEGVAHFINQEKPQEISMHIYDFVKKE
```

Siraitia grosnevorii (SgEPH4)
                                                        (SEQ ID NO: 186)
```
MAENIEHTTVQTNGIKMHVAAIGTGPPVLLLHGFPELWYSWRHQLLYLSSAGYRAIAPDLRGYG

DTDAPPSPSSYTALHIVGDLVGLLDVLGIEKVFLIGHDWGAIIAWYFCLERPDRIKALVNLSVQ

FFPRNPTTPFVKGFRAVLGDQFYMVRFQEPGKAEEEFASVDIREFFKNVLSNRDPQAPYLPNEV

KFEGVPPPALAPWLTPEDIDVYADKFAETGFTGGLNYYRAFDRTWELTAPWTGARIGVPVKFIV

GDLDLTYHFPGAQKYIHGEGFKKAVPGLEEVVVMEDTSHFINQERPHEINSHIHDFFSKFC
```

Cucumis melo (CmEPH1)
                                                        (SEQ ID NO: 187)
```
MADKIQHSTISTNGINIHFASIGSGPVVLFLHGFPELWYSWRHQLLFLASKGFRAIAPDLRGFG

DSDAPPSPSSYTPHHTVGDLTGLLDHLGIDQVFLVGHDWGAMMAWYFCLFRPDRVKALVNTSVH

YTPRNPAGSPLAVTRRYLGDDFYICKFOEPGVAEADFGSVDTATMMKKFLTMRDPRPAIIPNGE

KTLLETPEILPSWLTEEDIEYFASKFSKTGETGGFNYYRALDITWELTGPWSRAQIKVPTKEIV

GDLDLVYNFPGAKEYIHGGGFKKDVPLLEDVVVIEGAAHFINQEKPDEISSLIYDFITKE
```

Cucumis melo (CmEPH2)
                                                        (SEQ ID NO: 188)
```
MAEKIEHTTIPTNGINMHVASIGSGPAVLFLHGFPQLWYSWRHQLLFLASKGFRALAPDLRGFG

DTDAPPSPSSYTFLHIIGDLIGLLDHLGLEKVFLVGHDWGAMIAWYFCLFRPDRVKALVNLSVY

YIKRHPSISFVDGFRAVAGDNFYICQFQEAGVAEADFGRVDTATMMKKFMGMRDPEAPLIFTKE

KGFSSMETPDPLPCWLTEEDIDFFATKFSKTGFTGGFNYYRALNLSWELTAAWNGSKIEVPVKE

IVGDLDLVYHFPGAKQYIHGGEFKKDVPFLBEVVVIKDAAHFIHQEKPHQINSLIYHFINKFST

STSPA
```

Trema orientals (ToEPH)
                                                        (SEQ ID NO: 189)
```
MAEKIEHTTINTNGVNLHVASIGTGPAVLFLHGFPELWYSWRHQMLALSSLGYRAIAPDLRGYG

DSDAPPSPESYSSLHIVGDLVGLIDQLGIDQIFLVGHDWGAVIAWQFCLFRFDRVKALVNMSVP

FRPRHPTRKPIETFRALFGDDYYVCRFQAPGEVEEDFASDDTANLLKKFYGGRNPRPPCVPKEI
```

-continued

GFKGLKAPELPSWLSEEDLNYFAEKFNQRGFTGGLNYYRALDLTWELTAAWTGVQVKVPTKEIV

GDLDITYHIPGAKEYINEGGLKKDVPYLQEVVVMEGVAHFVNQEKAEEVSAHIHDFIKKF

Arachis hypogaea (AhEPH)
(SEQ ID NO: 190)
MAEKTEHTWVNTNGIKMHVASIGSGPAVLFLHGFPELWYSWRHQLLSLSAQCYRCIAPDLRGYG

DTDAPPSPSSYSALHIVSDLVGLLDALRIDQVFLVGHDWGAAMAWYFCLFRPDRIKALVNMSVV

FRPRNPKWKPLQSLRAMLGDDYYICRFQKPGEAEEEFARAGTSRIIKTFLVSRDPRPPCVPKEI

GFGGSPNLQLALPSWLTEEDVNYYASKFDQKGFTGGLNYYRAIDLTWELTAPWTGVQIKVPVKE

IVGDLDVTYNTPGVKEYIHGGGFKKEVPFLQELVVMEGVAHFINQERPDEISAHIHDFIKKF

Mycobacterium tuberculosis (MtEPH)
(SEQ ID NO: 212)
MASQVHRILNCRGTRIHAVADSPPDQQGPLVVLLHGFPESWYSWRHQIPALAGAGYRVVAIDQR

GYGRSSKYRVQKAYRIKELVGDVVGVLDSYGAEQAFVVGHDWGAPVAWTFAWLHPDRCAGVVGI

SVPFAGRGVIGLPGSPFGERRPSDYHLELAGPGRVWYQDYFAVQDGIITEIEEDLRGWLLGLTY

TVSGEGMMAATKAAVDAGVDLESMDPIDVIRAGPLCMAEGARLKDAFVYPETMPAWFTEADLDF

YTGEFERSGFGGPLSFYHNIDNDWHDLADQQGKPLTPPALFIGGQYDVGTIWGAQAIERAHEVM

PNYRGTHMIADVGHWIQQEAPEETNRLLLDFLGGLRP

Cytochrome P450
Siraitia grosvenorii CYP87D18
(SEQ ID NO: 73)
MWTVVLGLATLFVAYYIHWINKWRDSKFNGVLPPGTMGLPLIGETIQLSRPSDSLDVHPFIQKK

VERYGPIFKTCLAGRPVVVSADAEFNNYIMLQEGRAVEMWYLDTLSKFFGLDTEWLKALGLIHK

YIRSITLNHFGAEALRERFLPFIEASSMEALHSWSTQPSVEVKNASALMVFRTSVNKMFGEDAK

KLSGNIPGKFTKLLGGFLSLPLNFPGTTYHKCLKDMKEIQKKLREVVDDRLANVGPDVEDFLGQ

AFKDKESEKFISEEFIIQLLFSISFASFESISTTLTLILKLLDEHPEVVKELEVEHEAIRKARA

DPDGPITWEEYKSMTFTLQVINETLRLGSVTPALLRKTVKDLQvKGKIIPEGWTIMLVTASRHR

DPKVYKDPHIFNPWRWKDLDSITIQKNFMPFGGGLRHCAGAEYSKVYLCTFLHILCTKYRWTKL

GGGTIARABIL SFE DGLHVKFTPKE

Cucumis melo
(SEQ ID NO: 74)
MWTILLGLATLAIAYYIHWVNKWKDSKENGVLPPGTMGLPLIGETIQLSRPSDSLDVHPFIQSK

VKRYGPIFKTCLAGRPVVVSTDAEFNHYIMLQEGRAVEMWYLDTLSKFFGLDTEWLKALGLIHK

YIRSITLNHFGAESLRERFLPRIEESARETLHYWSTQPSVEVKESAAAMVFRTSIVKMFSEDSS

KLLTAGLTKKFTGLLCGFLTLPLNVPGTTYHKCIKDMKEIQKKLKDILEERLAKCVSIDEDFLC

QAIKDKESQQFISEEFIIQLLFSISFASFESISTTLTLILNFLADHPDVAKELEAEHEAIRKAR

ADPDGPITWEEYKSMNFTLNVICETLRLGSVTPALLRKTTKEIQIKGYTIPEGWTVMLVTASRH

RDPEVYKDPDTFNPWRWKELDSITIQRNFMPFGGGLRHCAGAEYSKVYLCTFLHILETKYRWRK

LKGGKIARAHILRFEDGLYVNFTPKE

Cucurbita maxima
(SEQ ID NO: 75)
MWTIVVGLATLAVAYYIHWINKWKDSKFNGVLPPGTMGLPLIGETLQLSRPSDSLDVHPFIKKK

VKRYGSIFKTCLAGRPVVVSTDAEFNNYIMLQEGRAVEMWYLDTLSKFFGLDTEWLKALGFIHK

YIRSITLNHFGAESLRERFLPRIEESAKETLCYWATQPSVEVKDSAAVMVFRTSMVKMVSKDSS

KLLTGGLTKKFTGLLGGFLTLPINVPGTTYNKCMKDMKEIQKKLREILEGRLASGAGSDEDFLG

QAVKDKGSQKFISDDFIIQLLFSISFASFESISTTLTLLLNYLADHPDVVKELEAEHEAIRNAR

ADPDGPITWEEYKSMTFTLHVIFETLRLGSVTPALLRKTTKELQINGYTIPEGNTVMLVTASRE

-continued

RDPAVYKDPHTFNPWRWKELDSITIQKNFMPFGGGLRHCAGAEYSKVYLCTFLHILFTKYRWTK

LKGGKVARAHILSFEDGLHMKFTPRE

*Cucumis sativus*
(SEQ ID NO: 76)
MWTILLGLATLAIAYYIHWVNKWKDSKFNGVLPPGTMGLPLIGETIQLSRPSDSLDVHPFIQRK

VKRYGPIFECTCLAGRPWVSTDAEFNHYIMLQEGRAVEMWYLDTLSKFFGLDTEWLKALGLIHK

YIRSITLNHFGAESLRERFLPRIEESARETLHYWSTQTSVEVKESAAAMVFRTSIVKMFSEDSS

KLLTEGLTKKFTGLLGGFLTLPLNLPGTTYHKCIKEMKQIQKKLKDILEERLAKGVKIDEDFLG

QAIKDKESQQFISEEFIIQLLFSISFASFESISTTLTLIINFLADHPDVVKELEAEHEAIRKAR

ADPDGPITWEEYKSMNFTLNVICETLRLGSVTPALLRKTTKEIQIKGYTIPEGWTVMLVTASRH

RDPEVYKDPDTFNPWRWKELDSITIQKNFMPFGGGLRHGAGAEYSKVYLCTFLHILFTKYRWRK

LKGGKIARAHILRFEDGLYVNFTPKE

*Cucurbita moschata*
(SEQ ID NO: 77)
MWAIVVGLATLAVAYYIHWINKWRDSRFNGVLPPGTMGLPLVGETLQLARPSDSLDVHPFIRRR

VKRYGSIFKTCLAGRPVVSTDAEFNNYIMLQEGRAVEMWYLDTLSKFFGLDTEWLKALGFIHK

YIRSITLNHFGAESLRERFLPRIEESAKETLRYWATQPSVEVKDSAAVMVFRTSMVKMVSEDSS

KLLTGGLTKKFTGLLGGFLTLPINVPGTTYNKCMKDMKEIQKKLREILEGRLASGAGSDEDFLG

QAIKDKGSQQFISDDFIIQLLFSISFASFESISTTLTLVLNYLADHPDVVKELEAEHEAIRNAR

ADPDGPITWEEYKSMTETLHVIFETLRLGSVTPALLRKTTKELQINGYTIPEGWTVMLVTASRH

RDPAVYKDPHTFNPWRWKELDSITIQKNFMPFGGGLRHCAGAEYSKVYLCTFLHILETKYRWTK

LKGGRVARAHILSFEDGLHVRFTPRE

*Prunus avium*
(SEQ ID NO: 78)
MWTLVGLSLVALLVIYFTHWIIKWRNPKCNGVLPPGSMGLPLIGETLNLIIPSYSLDLHPFIKR

RLQRYGPIFRTSLAGRPVVVTADPEFNNYIFQQEGRMVELWYLDIFSKIFVHEGDSKTNAIGMV

HKYVRSIFLNEFGAERLKEKLLPQIEEFVNKSLCAWSSKASVEVKHAGSVMVFNFSAKQMISYD

AEKSSDDLSEKYTKIIDGLMSFPLNIPGTAYYNCSKHQKNVTTMLRDMLKERRISPETRRGDFL

DQLSIDMEKEKFLSEDFSVQLVFGGLFATFESISAVIALAFSLLADHPSVVEELTAEHEAILKN

RENPNSSITWDEYKSMTFTLQVINEILRLGNVAPGLLRRALKDIPVKGFTIPEGWTIMVVTSAL

QLSPNTFEDPLEFNPWRWKDLDSYAVSRNFMPFGGGMRQCAGAEYSRVFLATFLHVLVTRYRWT

TIKAARIARNPILGFGDGIHIKFEEKRT

*Populus trichocarpa*
(SEQ ID NO: 79)
MWAIGLVVVAIVVIYYTHMIFKWRSPKIEGVLPPGSMGWPLIGETLQEISPGKSLDLHPEVKKR

MEKYGPIFKTSLVGRPIIVSTDYEMNKYILQHEGTLVELWYLDSFAKFFALEGETRVNAIGTVH

KYLRSITLNHFGVESLKESLLPKIEDMLHTNLAKWASQGPVDVKQVISVMVFNFTANKIFGYDA

ENSKEKLSENYTKILNSFISLPLNIPGTSFHKCMQDREKMLKMLKDTLMERLNDPSKRRGDFLD

QAIDDMKTEKFLTEDFIPQLMFGILFASFESMSTTLTLTFKFLTENPRVVEELRAEHEAIVKKR

ENPNSRLTWEEYRSMTFTQMVVNETLRISNIPPGLFRKALKDFQVKGYTVPAGWTVMLVTPATQ

LNPDTFKDPVTFNPWRWQELDQVTISKNFMPFGGGTRQCAGAEYSKLVLSTFLHILVTNYSFTK

IRGGDVSRTPIISFGDGIHIKFTARA

*Primus persica*
(SEQ ID NO: 80)
MWTLVGLSLVGLLVIYFTHWIIKWRNPKCNGVLPPGSMGLPFIGETLNLIIPSYSLDLHPFTKK

RLQRYGPIFRTSLAGRQVVVTADPEFNNYLFQQEGRMVELWYLDTFSKIFVHEGESKTNAVGMV

-continued

HKYVRSIFLNHFGAERLKEKLLPQIEEFVNKSLCAWSSKASVEVKHAGSVMVFNFSAKQMISYD

AEKSSDDLSEKYTKIIDGLMSFPLNIPGTAYYNCLKHQKNVTTMLRDMLKERQISPETRRGDFL

DQISIDMEKEKFLSEDFSVQLVFGGLFATFESISAVLALAFSLLAEHPSVVEELTAEHEAILKN

RENLNSSLTWDEYKSMTFTLQVINEILRLGNVAPGLLRRALKDIPVKGFTIPEGWTIMVVTSAL

QLSPNTFEDPLEFNPWRWKDLDSYAVSKNFMPFGGGMRQCAGAEYSRVFLATFLHVLVTKYRWT

TIKAARIARNPILGFGDGIHIKFEEKKT

Populus euphratica
(SEQ ID NO: 81)
MWTFVLCVVAVLVVYYIHWINKWRNPTCNGVLPPGSMGLPLLGETLELLLPSYSLDLHPFLKKR

IQRYGPIFRTNILGRPAVVSADPEINSYIFQNEGKLVEMWYMDTFSKLFAQSGESRTNAFGIIE

KYARSLTLTHFGSESLKERLLPQVENIVSKSLQMWSSDASVDVKPAVSIMVCDFTAKQLFGYDA

ENSSDKISEKFTKVIDAFMSLPLNIPGTTYHKCLKDKDSTLSILRNTLKERMNSPAESRGGDFL

DQIIADMDKEKFLTEDFTVNLIFGILFASFESISAALTLSLKLIGDHPSVLEELTVEHEAILKN

RENPDSPLTWAEYNSMTFSLQVINETLRLGNVAPGLLRRALQDMQVKGYTIPAGWVIMVVNSAL

HLNPATFKDPLEFNPWRWKDFDSYAVSKNLMPFGGGRRQCAGSEFTKLFMAIFLHKLVTKYRWN

IIKQGNIGRNPILGEGDGIHISFSPKDI

Juglans regia
(SEQ ID NO: 82)
MWKVGLCVVGVIVVWFTRWINKWRNPKCNGILPPGSMGPPLIGESLQLIIPSYSLDLHPFIKKR

VQRYGPIFRTSVVGQPMVVSTDVEFNHYLAKQEGRLVHFWYLDSFAEIFNLEDENAISAVGLIH

KYGRSIVLNHFGTDSLKKTLLSQIEEIVNKTLQTWSSLPSVEVKHAASVMAFDLTAKQCFGYDV

ENSAVKMSEKFLYTLDSLISFPFNIPGTVYHKCLKDKKEVLNMLRNIVKERMNSPEKYRGDFLD

OTTADMNKESFLTQDFIVYLLYGLLFASFESISASLSLTLKTLARHPAVLQQLTAFHEAILKNR

DNPNSSLTWDEYKSMTETFQVINEALRLGNVAPGLLRRALKDIEFKGYTIPAGWTIMLANSAIQ

LNPNTYEDPLAFNPWRWQDLDPQIVSKNFMPFGGGIRQCAGAEYSKTFLATFLHVLVTKYRWTK

VKGGKMARNPILWFADGIHINFALKHN

Pyrus x bretschneideri
(SEQ ID NO: 83)
MWDVVGLSFVALLVIYLTYWITQWKNPKCNGVLPPGSMGLPLIGETLNLLIPSYSLDLHPFIRK

RLERYGPIFRTSLAGKPVLVSADPEFNNYVLKQEGRMVEEWYLDTFSKIFMQEGGNGTNQIGVI

HKYARSIFLNEFGAECIKEKLLTQIEGSINKHLRAWSNQESVEVKKAGSIMALNFCAEHMIGYD

AETATENLGEIYHRVFQGLISFPLNVPGTAYHNCLKIHKKATTMLRAMLRERRSSPEKRRGDFL

DQIIDDLDQEKFLSEDFCIHLIFGGLFAIFESISTVLTLFFSLLADHPAVLQELTAEHEALLKN

REDPNSALTWDEYKSMTFTLQVINETLRLVNTAPGLLRRALKDIPVKGYTIPAGWTILLVTPAL

HLTSNTFKDHLEFNPWRWKDLDSLVISKNFMPFGSGLRQCAGAEFSRAYLSTFLHVLVTKYRWT

TIKGARISRRPMLTFGDGAHIKFSEKKN

Morus notabilis
(SEQ ID NO: 84)
MWNTICLSVVGLVVIWISNWIRRWRNPKCNGVLPPGSMGEPLIGETLPLIIPTYSLDLHPFIKN

RLQRYGSIFRTSIVGRPVVISADPEFNNFLQQEGSLVELYYLDTFSKIFVHEGVSRTNEFGVV

HKYIRSIFLNHFGAERLKEKLLPEIEQMVNKTLSAWSTQASVEVKHAASVLVLDFSAKQIISYD

AKKSSESLSETYTRIIQGFMSFPLNIPGTAYNQCVKDQKKIIAMLRDMLKERRASPETNRGDFL

DQISKDMDKEKFLSEDFVVQLIFGGLFATFESVSAVLALGFMLLSEHPSVLEEMIAEHETILKN

REHPNSLLAWGEYKSMTFTLQVINETLRLGNVAPGLLRKALKDIRVKGFTIPKGWAIMMVTSAL

-continued

QLSPSTFKNPLEFNPWRWKDLDSLVISKNFMPFGRGMRQCAGAEYSRAFMATFFHVLLTKYRWT

TIKVGNVSRNPILRFGNGIHIKFSKKN

*Jatropha curcas* (JcP450.1)
(SEQ ID NO: 85)
MWIIGLCFASLLVIYCTHFFYKWRNPKCKGVLPPGSMGLPIIGETLQLIIPSYSLDHHPFIQKR

IQRYGPIFRTNLVGRPVIVSADPEVNQYIFQQEGNSVEMWYLDAYAKIFQLDGESRLSAVGRVH

KYIRSITLNNFGIENLKENLLPQIQDLVNQSLQKWSNKASVDVKQAASVMVFNLTAKQMFSYGV

EKNSSEEMTEKFTGIFNSLMSLPLNIPGTTYHKCLKDREAMLKMLRDTLKQRLSSPDTHRGDFL

DQAIDDMDTEKFLTGDCIPQLIFGILLAGFETTATTLTLAFKFLAEHPLVLEELTAEHEKILSK

RENLESPLTWDEYKSMTFTHHVINETLRLANFLPGLLRKALKDIQVKNYTIPAGWTIMVVKSAM

QLNPEIYKDPLAFNPWRWKDLDSYTVSKNFMPFGGGSRQCAGADYSKLFMTIFLHVLVTKYRWR

KIKGGDIARNPILGFGDGLHIEVSAKN

*Hevea brasiliensis*
(SEQ ID NO: 86)
MLTVVLLLVGFFIIYYTYWISKWRNPNCNGVLPPGSMGFPLIGETLQLLIPSYSLDLHPFIKKR

IHRYGPIFRSNLAGRPVIVSADPEFNYYILSQEGRSVEIWYLDTFSKLFRQQGESRTNVAGYVH

KYLRGAFLSQIGSENLREKLLLHIQDMVNRTLCSWSNQESVEVKHSASLAVCDFTAKVLFGYDA

EKSPDNLSETFTRFVEGLISFPLNIPRTAYRQCLQDRQKALSILKNVLTDRRNSVENYRGDVLD

LLLNDMGKEKFLTEDFICLIMLGGLFASFESISTITTLLLKLFSAHPEVVQELEAEHEKILVSR

HGSDSLSITWDEYKSMTFTHQVINETLRLGNVAPGLLRRAIKDVQFKGYTIPSGWTIMMVTSAQ

QVNPEVYKDPLVFNPWRWKDFDSITVSKNFTPFGGGTRQCVGAEYSRLTLSLFIHLLVTKYRWT

KIKEGEIRRAPMLGFGDGIHFKFSEKE

*Jatropha curcas* (JcP450.2)
(SEQ ID NO: 87)
MKRAIYICLARITKQGLSLIEMLMTELLFGAFFIIFLTYWINRWRNPKCNGVLPPGSMGLPLLC

ETLQLLIPRYSLDLHPFIRKRIQRYGPIFRSNVAGRPIVETADPELNHYIFIQERRLVELWYMD

TFSNLFVLDGESRPTGATGYIHKYMRGLFLTHFGAERLKDKLLHQIQELIHTTLQSWCKQPTIE

VKHAASAVICDFSAKFLFGYEAEKSPFNMSERFAKFAESLVSFPLNIPGTAYHQSLEDREKVMK

LLKNVLRERRNSTKKSEEDVLKQILDDMEKENFITDDFIIQILFGALFAISESIPMTIALLVKF

LSAQPSVVEELTAEHEEILKNKKEKGLDSSITWEDYKSMTFTLQVINETLRIANVAPGLLRRTL

RDIHYKGYTIPAGWTIMVLTSSRHMNPEIYKDPVEFNPWRWKDLDSQTISKNFTPFGGGTRQCA

GAEYSRAFISMFLHVLVTKYRWKNVKEGKICRGPILRIEDGIHIKLYEKH

*Chenopodium quinoa*
(SEQ ID NO: 88)
MWPTMGLYVATIVAICFILLELKRRNSREKQVVLPPGSKGFPLIGETLQLLVPSYSLDLPSFTR

TRIQRYGPIFKTRLVGRPVVMSADPGFNRYIVQQEGKSVEMWYLDTFSKLFAQDGEARTTAAGL

VHKYLRNLTLSHFGSESLRVNLLPHLESLVRNTLLGWSSKDTIDVKESALTMTIEFVAKQLFGY

DSDKSKEKIGEKFGNISQGLFSLPLNIPGTTYHSCLKSQREVMDMMRTALKDRLTTPESYRGDF

LDHALKDLSTEKFLSEEFILQIMFGLLFASSESTSMTLTLVLKLLSENPHVLKELEAEHERIIK

NKESPDSPLTWAEVKSMTFTLQVINESLRLGNVSLGILRRTLKDIEINGYTIPAGWTIMLVTSA

CQYNSDIYKDPLTFNPWRWKEMQPDVIAKNFMPFGGGTRQCAGAEFAKVLMTIFLHNLVTNYRW

EKIKGGEIVRTPILGFRNALRVKLTKKN

*Spinacia oleracea*
(SEQ ID NO: 89)
MVLLPGSKGFPFIGETLQLLLPSYSLDLPSEIRTRIQRYGPIEQTRLVGRPVVSADPGFNRYI

VQQEGKMVEMWYLDTFSKIFAQQGEGRTNAAGLVHKYLRNITFTHFGSQTLRDKLLPHLEILVR

-continued

KTLHGWTSQESIDVKEAALTMTIEFVAKQLFGYDSDKSKERIGDKFANISQGLLSFPLNIPGTT

YHSCLKSQREVMDMMRKTLKERLASPDTCQGDFLDHALKDLNTDKFLTEDFILQIMFGLLFASS

ESTSITLTLILKFLSENPHVLEELEVEHERILKNRESPDSPLTWAEVKSMTFTLQVINESLRLG

NVSLGLLRRTLKDIEINGYTIPAGWTIMLVTSACQYNSDVYKDPLTFNPWRWKEMQPDVIAKNE

MPFGGGTRQCAGAEFAKVLMTIFLHVLVTTYRWEKIKGGEIIRTPILGFRNGLHVKLIKKARLS

Manihot esculenta
(SEQ ID NO: 90)
MEMWSVWLYIISLIIIIATHWTYRWRNPKCNGKLPPGSMGIPPIGETIQFLIPSKSLDVPNFIK

KRMNKYGPLFRTNLVGRPVIVSSDPDFNYYLLQREGKLVERWYMDSFSKLLHHDVTQIIIKHGS

IHKYLRNLVLGHFGPEPLKDKLLPQLESAISQRLQDWSKQPSIEAKSASSAMIFDFTAKILFSY

EPEKSGENIGEIFSNFLQGLMSIPLNIPGTAFHRCLKNQKRAIQMITEILKERRSNPEIHKGDF

LDQIVEDMKKDSFWTEEFATYMMFGLLLASFETISSTLALAIIFLTDNPPVVQKLTEEHEAILK

ARENRDSGLSWKEYKSLSYTHQVVNESLRLASVAPGILRRAITDIQVDGYTIPKGWTIMVVPAA

VQLNPNTFEDPLVFNPSRWEDMGAVAMAKNFIAFGGGSRSCAGAEFSRVLMSVFVHVFVTNYRW

TKIKGGDMVRSPALGFGNGFHIRVSEKQL

Olea europaea var. sylvestris
(SEQ ID NO: 91)
MAALDLSTVGYLIVGLLTVYITHWIYKWRNPKCNGVLPPGSMGLPLIGETIQLVIPNASLDLPP

FIKKRMKRYGPIFRTNVAGRPVIITADPEFNHFLLRQDGKLVDTWSMDTFAEVFDQASQSSRKY

TRHLTLNHFGVEALREKLLPQMEDMVRTTLSNWSSQESVEVKSASVTMAIDYAARQIYSGNLEN

APLKISDLFRDLVDGLMSFPINIPGTAHHRCLQTHKKVREMMKDIVKTRLEEPERQYGDMLDHM

IEDMKKESFLDEDFIVQLMFGLFFVTSDSISTTLALAFKLLAEHPLVEELTAEHEAILKKREK

SESHLTWNDYKSMTETLQVINEVLRLGNIAPGFFRRALQDIPVNGYTIPSGWVIMIATAGLHLN

SNQFEDPLKFNPWRWKVCKVSSVIAKCFMPFGSGMKQCAGAEYSRVLLATFTHVLTTKYRWAIV

KGGKIVRSPIIRFPDGFHYKIIEKTN

Cucurbita pepo subsp. pepo
(SEQ ID NO: 171)
MWAIVVGLATLAVAYYIHWINKWKDSKFNGVLPPGTMGLPLVGETLQLARPSDSLDVHPFIKKK

VKRYGPIFKTCLAGRPVVVSTDAEFNNYIMLQEGRAVEMWYLDTLSKFFGLDTEWLKALGFIHK

YIRSITLNHFGAESLRERFLPRIEESAKETLRYWATQFSVEVKDSAAVMVFRTSMVKMvSEDSS

KLLTGGLTKKFTGLLGGFLTLPINVPGTTYNKCMKDMKEIQKKLREILEGRLASGGGSDEDFLG

QAIKDKGSQQFISDDFIIQLLFSISFASFESISTTLTLVLNYLADHPDVVKELEAEHEAIRNAR

ADPDGPITWEEYKSMTFTLHVIFETLRLGSVTPALLRKTTKELQINGYTIPEGWTVMLVTASRH

RDPAVYKDPHTFNPWRWKELDSITIQKNFMPFGGGLRHCAGAEYSKVYLCTFLHILFTKYRWTK

LKGGKVARAHILSFEDGLHVKFTPKE

Capsella rubella CYP705A38
(SEQ ID NO: 172)
MATLMTIDLQNCFIFTILSLLCYYLLFKKQKGSRAGCVLPPSPPSLPIIGHLHLLLSNLTHKSL

QNISTKFGSFLYLRVVNLPIVLVSSPSVAYEIYKTHDVNVSSRVATSLGDSLFLGSSGFITAPY

GDYWKFMKKMVATKLLRPQAIEQSRGGRAEELQMFYENLLDKAMKKESIEVSKEAMKLTNNIIC

RMSMGRSCSDENGEAERVRELLVKSTALTKKIFFANMFPRIPLFKKEIMGVSSEFDDLLERLLV

EHEERVEEHENKDMMDLLLEAYRDENAEYKISRKQIKSLFVEIFLGGTDTSAQTVQWILAELIN

-continued

KPNILERIREEIDSVVGKSRLMKETDLPNLPYLQATVKEGLRMHPPSPLLVRTFQESCEVKGFY

MPEKTMLVINVYALMRDPDTWEDPNEFKPERFLLSSRSRQEDEKEQGMMKYLPFGAGRRGCPGS

NLAYLFVGIAVGVMVQCFDWKIKEDKVNMEETTAGMNLAMAHPFKCTPVVRNDPLTLNLENPSS

Brassica rapa CYP705A37v2
(SEQ ID NO: 173)
MIVDFQNCSIEILLCEETELCYSVEEEFKKTNDLGPSPPSLPIIGHLHHELSGLPHKAFQKIST

KYGPLLHLHIFSFPIVLVSSPTMAHEIFTTHDLNISSRNTPAIDESLLFGPSGFTVAPYGDYVK

FIKKLLATKLLRPRAIEKSRGVRAEELKQFYLKVQDKALKKESIEIGKETMKFTNNMICRMSIG

RSFSEENGEVETLRELIIKSFALSKQILFVNVLRRPLEMLGLMSLFKKDIMDVSRGFDELLERV

LAEHEEKREEDQDMDMMDLLLEACRDENAEYKITRNQIKSLFVEIFLGGTDTSAHTTQWTMAEL

VNNPNILGRLRDEIDLVVGKERLIQETDLPNLPYLQAVVKEGLRLHPPAPLLVRMFDKKCVIKD

FFKVPEKTTLVVNVYGVMRDPDSWEDPNEFKPERFLTSKQEEDKVLKYLPFAAGRRGCPATNVG

YIFVGTSIGMMVQCFDWSIKEKVSMEEVYAGMSLSMAHPPTCTPVSRLSL

Siraitia grosvenorii
(SEQ ID NO: 174)
MDFFSAFLLLLLTVLILLQIRTRRRNLPPSPPSLPIIGHLHLLKRPIHRNFHKIAAEYGPIFSL

RFGSRLAVIVSSLDIAEEECFTKNDLIFANRPRLLISKHLGYNCTTMATSPYGDHWRNLRRLAAI

EIFSTARLNSSLSIRKDEIQRLLLKLHSGSSGEFTKVELKTMFSELAFNALMRIVAGKRYYGDE

VSDEEEAREFRGLMEEISLHGGASHWVDFMPLLKWIGGGGFEKSLVRLKRTDKEMQALIEERR

NKKVLERKNSLLDRLLELQASEPEYYTDQIIKGLVLVLLRAGTDTSAVTLNWAMAQLLNNPELL

AKAKAELDTKIGQDRPVDEPDLPNLSYLQAIVSETLRLHPAAPMLLSHYSSADCTVAGYDIPRG

I1LLVNAWALHRDPKLWDDPTSFRPERELGAANELQSKKLLAEGLGRRSCPGDTMALREVGLAL

GLLIQCYQWKKCGDEKVDMGEGGGITIHKAKPLEAMCKARPAMYKLLLNALDKI

Camelina sativa
(SEQ ID NO: 175)
MATMMIFDFQNCFIFIILCFVSLLCYTILFKKQESSRTGCVLPPSPPSLPIIGHLHLLLSSLTH

KSLHNISSKFGPPFLYLRVVNLPIVLVSSASVAYEIYKTQDVNVSSRVATSLGDSLFLGSSGFIT

APYGDYWKFMKKMVATKLLRPQAIEQSRGGRAEELQGLYENLLDKRMKKESIEISKEAMKFTNN

IICRMSMGRSCSDENGEAEIVRELLVKSTALTKKIFFANMFPRIPLFKKEIMGVSNQFDELLER

LLVEHEERVEEHENKDMMDLLLEAFRDEHAEYKISRKQIKSLFVEIFLGGTDTSAQTVQWIMAE

LINKPSIIEKIREBIDSVVGKTRLIKETDLPKLPYLQVVVKEGLRMHPPSPLVVRTFQESCEVK

GFYMPEKTMLVINVYALMRDPESWEDPNEFKPERFLPSSKSRQDEEKEQGLKYLPFGAGRRGCP

GSNLAYLFVGLAVGVMVQCFDWKIKEDKVNMEETTAGMNLAMAHPFKCTPVVRIDPLTFNLKSP

SP

Raphanus sativus
(SEQ ID NO: 176)
MAPMTIDFQTCFIFILLSFFSFFCYFFFFKKTNDLGPSPPSLPIIGHLHHFLSVLPHKAFQQIS

TKYGPLLHLRIFSFPIVLVSSATMAYEIFTTHDLNISSRNAPAIDESLVFGSSGFIVSPYGDYV

KFIKKLLATKLLRPRAIEKSRGVRAEELKQFYLKLHDKALKKESIEIGNETMKFTNNMICGMSM

GRSCSEENGETETVRGLINKSFALSRKILFVNVLRRPLEKLGLLSLFKKDILDVSNRFDELLER

ILLEHEEKPEEEQDMDMMDLLLEASRDENAEYKITRNQIKALFVEIFMGGTDTSAHTTQWTMAE

LVNNPNSLEKLRDEIDMVVGKSRLIQETDLPNLPYLQAVVKEGLRLHPPAPLLVRMFEKKCVIK

DFFNVPEKTTLVVNLYGVMRDPDSWEDPNEFKPERFLTSKQEEEKTLKYLPFAAGRRGCPATNV

AYIFVGISIGMMVQCFDWSIKDKVSMEEVYAGMSLSMAHPPKFTPVSRLSL

Cucumis sativus (CsCYP87D20)

-continued (SEQ ID NO: 194)
MAWTILLGLATLAIAYYIHWVNKWKDSKFNGVLPPGTMGLPLIGETIQLSRPSDSLDVHPFIQR

KVKRYGPIFKTCLAGRPVVVSTDAEFNHYIMLQEGRAVEMWYLDTLSKFFGLDTEWLKALGLIE

KYIRSITLNHFGAESLRERFLPRIEESARETLHYWSTQTSVEVKESAAAMVFRTSIVKMFSEDS

SKLLTEGLTKKFTGLLGGFLTLPLNLPGTTYHKCIKDMRQIQKKLKDILEERLAKGVKIDEDFL

GQAIKDKESQQFISEEFIIQLLFSISFASFESISTTLTLLLNFLADHPDVVKELEAEHEAIRKA

RADPDGPITWEEYKSMNFTLNVICETLRLGSVTPALLRKTTKEIQIKGYTIPEGWTVMLVTASR

HRDPEVYKDPDTFNPWRWKELDSITIQKNFMPFGGGLRHCAGAEYSKVYLCTFLHILFTKYRWR

KLKGGKIALIAHILRFEDGLYVNFTPKE

*Cucumis sativus* (sohB_CsCYP87D20)

(SEQ ID NO: 195)
MALLSEYGLFLAKIVTVVLAIAAIAAIIHWVNKWKDSKFNGVLPPGTMGLPLIGETIQLSRPSD

SLDVHPFIQRKVKRYGPIFKTCLAGRPVVVSTDAEFNHYIMLQEGRAVEMWYLDTLSKFFGLDT

EWLKALGLIHKYIRSITLNHFGAESLRERFLPRIEESARETLHYWSTQTSVEVKESAAAMVFRT

SIVKMFSEDSSKLLTEGLTKKFTGLLGGFLTLPLNLPGTTYHKCIKDMKQIQKKLKDILEERLA

KGVKIDEDFLGQAIKDKESQQFISEEFIIQLLFSISFASFESISTTLTLILNFLADHPDVVKEL

EAEHEAIRKARADPDGPITWEEYKSMNFTLNVICETLRLGSVTPALLRKTTKEIQIKGYTIPEG

NTVMLVTASRHRDPEVYKDPDTFNPWRWKELDSITIQKNFMPFGGGLRHCAGAEYSKVYLCTFL

HILFTKYRWRKLKGGKIARAHILRFEDGLYVNFTPKE

*Cucumis sativus* (zipA_CsCYP87D20)

(SEQ ID NO: 196)
MAQDLRLILIIVGAIAIIALLVHGFHWVNKWKDSKFNGVLPPGTMGLPLIGETIQLSRPSDSLD

VHPFIQRKVKRYGPIFKTCLAGRPVVVSTDAEFNHYIMLQEGRAVEMWYLDTLSKFFGLDTEWI

KALGLIHKYIRSITLNHFGAESLRERFLPRIEESARETLHYWSTQTSVEVKESAAAMVFRTSIV

KMFSEDSSKLLTEGLTKKFTGLLGGFLTLPLMLPGTTYHKCIKDMKQIQKKLKDILEERLAKGV

KIDEDFLGQAIKDKESQQFISEEFTIQLLFSISFASFESISTTLTLILNFLADHPDVVKELEAE

HEAIRKARADPDGPITWEEYKSMNFTLNVICETLRLGSVTPALLRKTTKEIQIKGYTIPEGWTV

MLVTASRHRDPEVYKDPDTENPWRWKELDSITIQKNFMPFGGGLRHCAGAEYSKVYLCTFLHIL

FTKYRWRKLKGGKIARAHILRFEDGLYVNFTPKE

*Cucumis sativus* (CsCYP87D20_mut)

(SEQ ID NO: 197)
MAWTILLGLATLAIAYYIHWVNKWKDSKFNGVLPPGTMGLPLIGETIQFSRPSDSLDVHPFIQR

KVKRYGPIFKTCIAGRPVVVSTDAEFNHYIMLQEGRAVEMWYLDTFSKFLGLDTEWLKALGLIE

KYIRSITLNHFGAESLRERFLPRIEESARETLHYWSTQTSVEVKESAAAMVFRTSIVKMFSEDS

SKLLTEGLTKKFTGLLGGFLTLPLNLPGTTYHKCIKDMKQIQKKLKDILEERLAKGVKIDEDFL

GQAIKDKESQQFISBEFIIQLLFSISFASFASISTTLTLILNFLADHPDVVKELEAEHEAIRKA

RADPDGPITWEEYKSMNFTLNVICETLRLGSVTPALLRKTTKEIQIKGYTIPEGWTVMLVTASR

HRDPEVYKDPDTFNPWRWKELDSITIQKNFMPFGGGLRHCAGAEYSKVYLCTFLHILFTKYRWR

KLKGGKIARALILREEDGLYVNFTPKE

*Cucumis sativus* (sohB_CsCYP87D20_mut)

(SEQ ID NO: 198)
MALLSEYGLFLAKIVTVVLAIAAIAAIIHWVNKWKDSKFNGVLPPCTMGLPLIGETIQFSRPSD

SLDVHPFIQRKVKRYGPIFKTCIAGRPVVVSTDAEFNHYIMLQEGRAVEMWYLDTFSKFLGLDT

EWLKALGLIHKYIRSITLNHFGAESLRERFLPRIEESARETLHYWSTQTSVEVKESAAAMVFRT

SIVKMFSEDSSKLLTEGLTKKFTGLLGGFLTLPLNLPGTTYHKCIKDMKQIQKKLKDILEERLA

-continued

KGVKIDEDFLGQAIKDKESQQFISEEFIIQLLFSISFASFASISTTLTLILNFLADHPDVVKEL

EAEHEAIRKARADPDGPITWEEYKSMNFTLNVICETLRLGSVTPALLRKTTKEIQIKGYTIPEG

WTVMLVTASRHRDPEVYKDPDTFNPWRWKELDSITIQKNFMPFGGGLRHCAGAEYSKVYLCTFL

HILFTKYRWRKLKGGKIARALILRFEDGLYVNFTPKE

Cucurbita pepo subsp. pepo (sohB_CppCYP)
(SEQ ID NO: 199)
MALLSEYGLFLAKIVTVVLAIAAIAAIIHWINKWKDSKFNGVLPPGTMGLPLVGETLQLARPSD

SLDVHPFIKKKVKRYGPIFKTCLAGRPVVVSTDAEFNNYIMLQEGRAVEMWYLDTLSKFFGLDT

EWLKALGFIHKYIRSITLNHFGAESLRERFLPRIEESAKETLRYWATQPSVEVKDSAAVMVFRT

SMVKMVSEDSSKLLTGGLTKKFTGLLGGFLTLPINVPGTTYNKCMKDMKEIQKKLREILEGRLA

SGGGSDEDFLGQAIKDKGSQQFISDDFIIQLLFSISFASFESISTTLTLVLNYLADHPDVVKEL

EAEHEAIRNARADPDGPITWEEYKSMTFTLHVIFETLRLGSVTPALLRKTTKEIQINGYTIPEG

WTVMLVTASRHRDPAVYKDPHTENPWRWKELDSITIQKNEMPFGGGLRHCAGAEYSKVILCTEL

HILFTKYRWTKLKGGKVARAHILSFEDGLHVKFTPKE

Cucurbita pepo subsp. pepo (17alpha_CppCYP)
(SEQ ID NO: 200)
MALLLAVFHWINKWKDSKFNGVLPPGTMGLPLVGETLQLARPSDSLDVHPFIKKKVKRYGPIFK

TCLAGRPVVVSTDAEFNNYIMLQEGRAVEMWYLDTLSKFFGLDTEWLKALGFIHKYIRSITLNE

FGAESLRERFLPRIEESAKETLRYWATQPSVEVKDSAAVMVFRTSMVKMVSEDSSKLLTGGLTK

KPTGLLGGFLTLPINVPGTTYNKCMKDMKEIQKKLRBILEGRLASGGGSDEDELGQAIKDKGSQ

QFISDDFIIQLLFSISFASFESISTTLTLVLNYLADHPDVVKELEAEHEAIRNARADPDGPITW

EEYKSMTFTLHVIFETLRLGSVTPALLRKTTKELQINGYTIPEGWTVMLVTASRHRDPAVYKDP

HTFNPWRWKELDSITIQKNFMPFGGGLRHCAGAEYSKVYLCTFLHILFTKYRWTKLKGGKVARA

HILSFEDGLHVKPTPKE

Siraitia grosvenorii (CYP1798)
(SEQ ID NO: 221)
MEMSSSVAATISIWMVVVCIVGVGWRVVNWVWLRPKKLEKRLREQGLAGNSYRLLFGDLKERAA

MEEQANSKPINFSHDIGPRVFPSMYKTIQNYGKNSYMWLGPYPRVHIMDPQQLKTVFTLVYDIQ

KPNLNPLIKFLLDGIVTHEGEKWAKHRKIINPAFHLEKLKDMIPAFFHSCNEIVNEWERLISKE

GSCELDVMPYLQNLAADAISRTAFGSSYEEGKMIFQLLKELTDLVVKVAFGVYIPGWRFLPTKS

NNKMKEINRKIKSLLLGIINKRQKAMEEGEAGQSDLLGILMESNSNEIQGEGNNKEDGMSIEDV

IEECKVFYIGGQETTARLLIWTMILLSSHTEWQERARTEVLKVFGNKKPDFDGLSRLKVVTMIL

NEVLRLYPPASMLTRIIQKETRVGKLTLPAGVILIMPIILIHRDHDLWGEDANEFKPERFSKGV

SKAAKVQPAFFPFGWGPRICMGQNFAMIEAKMALSLILQRFSFELSSSYVHAPTVVFTTQPQHG

AHIVLRKL

Cytochrome P450 Reductase
Stevia rebaudiana (SrCPR1)
(SEQ ID NO: 92)
MAQSDSVKVSPFDLVSAAMNGKAMEKLNASESEDPTTLPALKMLVENRELLTLFTTSFAVLIGC

LVFLMWRRSSSKKLVQDPVPQVIVVKKKEKESEVDDGKKKVSIFYGTQTGTAEGFAKALVEEAK

VRYEKTSFKVIDLDDYAADDDEYEEKLKKESLAFFFLATYGDGEPTDNAANFYKWFTEGDDKGE

NLKKLQYGVFGLGNRQYEHFNKIAIVVDDKLTEMGAKRLVPVGLGDDDQCIEDDFTAWKELVWP

ELDQLLRDEDDTSVTTPYTAAVLEYRVVYHDKPADSYABDQTHTNGHVVHDAQHPSRSNVAFKK

ELHTSQSDRSCTHLEFDISHTGLSYETGDHVGVYSENLSEVVDEALKLLGLSPDTYFSVHADKE

DGTPIGGASLPPPFPPCTLRDALTRYADVLSSPKKVALLALAAHASDPSEADRLKFLASPAGKD

EYAQWIVANQRSLLEVMQSFPSAKPPLGVFFAAVAPRLQPRYYSISSSPKMSPNRIHVTCALVY

ETTPAGRIHRGLCSTWMKNAVPLTESPDCSQASIFVRTSNFRLPVDPKVPVIMIGPGTGLAPFR

GFLQERLALKESGTELGSSIFFFGCRNRKVDFTYEDELNNFVETGALSELIVAFSREGTAKEYV

QHKMSQKASDIWKLLSEGAYLYVCGDAKGMAKDVHRTLHTIVQEQGSLDSSKAELYVKNLQMSG

RYLRDVW

*Arabidopsis thaliana* CPR1 (AtCPR1)
(SEQ ID NO: 93)
MATSALYASDLFKQLKSIMGTDSLSDDVVLVIATTSLALVAGFVVLLWKKTTADRSGELKPLMI

PKSLMAKDEDDDLDLGSGKTRVSIFFGTQTGTAEGFAKALSEEIKARYEKAAVKVIDLDDYAAD

DDQYEEKLKKETLAFFCVATYGDGEPTDNAARFYKWFTEENERDIKLQQLAYGVFALGNRQYEH

FNKIGIVLDEELCKKGAKRLIEVGLGDDDQSIEDDFNAWKESLWSELDKLLKDEDDKSVATPYT

AVIPEYRVVTHDPRFTTQKSMESNVANGNTTIDIHHPCRVDVAVQKELHTHESDRSCIHLEFDI

SRTGITYETGDHVGVYAENHVEIVEEAGKLLGHSLDLVFSIHADKEDGSPLESAVPPPFPGPCT

LGTGLARYADLLNPPRKSALVALAAYATEPSEAEKLKHLTSPDGKDEYSQWIVASQRSLLEVMA

AFPSAKPPLGVFFAAIAPRLQPRYYSISSSPRLAPSRVHVTSALVYGPTPTGRIHKGVCSTWMK

NAVPAEKSHECSGAPIFIRASNFKLPSNPSTPIVMVGPGTGLAPFRGFLQERMALKEDGEELGS

SLLEEGCRNRQMDELYEDELNNFVDQGVLSELIMAFSREGAQKEYVQHKMMEKAAQVWDLLKEE

GYLYVCGDAKGMARDVHRTLHTIVQEQEGVSSSEAEAIVKKLQTEGRYLRDVW

*Arabidopsis thaliana* CPR2 (AtCPR2)
(SEQ ID NO: 94)
MASSSSSSTSMIDLMAAIIKGEPVIVSDPANASAYESVAAELSSMLIENRQFAMIVTTSIAVL

IGCIVMLVWRRSGSGNSKRVEPLKPLVIKPREEEIDDGRKKVTIFFGTQTGTAEGFAKALGEEA

KARYEKTRFKIVDLDDYAADDDEYEEKLKKEDVAFFFLATYGDGEPTDNAARFYKWFTEGNDRG

EWLKNLKYGVFGLGNRQYEHFNKVAKVVDDILVEQGAQRLVQVGLGDDDQCIEDDFTAWREALW

PELDTILREEGDTAVATPYTAAVLEYRVSIHDSEDAKFNDINMANGNGYTVFDAQHPYKANVAV

KRELHTPESDRSCIHLEFDIAGSGLTYETGDHVGVLCDNLSETVDEALRLLDMSPDTYFSLHAE

KEDGTPISSSLPPPFPPCNLRTALTRYACLLSSPKKSALVALAAHASDPTEAERLKHLASPAGK

DEYSKWVVESQRSLLEVMAEFPSAKPPLGVFFAGVAPRLQPRFYSISSSPKIAETRIHVTCALV

YEKMPTGRIHKGVCSTWMKNAVPYEKSENCSSAPIEVRQSNFKLPSDSKVPIIMIGPGTGLAPF

RGFLQERLALVESGVELGPSVLFFGCRNRRMDFIYEEELQRFVESGALAELSVAFSREGPTKEY

VQHKMMDKASDLWNMLSQGAYLYVCGDAKGMARDVHKSLH1LAMEQGSMDSTKAEGEVKNLMTS

GRYLRDVW

*Arabidopsis thaliana* (AtCPR3)
(SEQ ID NO: 95)
MASSSSSSTSMIDLMAAIIKGEPVIVSDPANASAYESVAAELSSMLIENRQFAMIVTTSIAVL

IGCIVMLVWRRSGSGNSKRVEPLKPLVIKPREEEIDDGRKKVTIFFGTQTGTAEGFAKALGEEA

KARYEKTRFKIVDLDDYAADDDEYEEKLKKEDVAFFFLATYGDGEPTDNAARFYKWFTEGNDRG

EWLKNLKYGVFGLGNRQYEHFNKVAKVVDDILVEQGAQRLVQVGLGDDDQCIEDDFTAWREALW

PELDTILREEGDTAVATPYTAAVLEYRVSIHDSEDAKFNDITLANGNGYTVFDAQHPYKANVAV

KRELHTPESDRSCIHLEFDIAGSGLTMKLGDHVGVLCDNLSETVDEALRLLDMSPDTYFSLHAE

KEDGTPISSSLPPPFPPCNLRTALTRYACLLSSPKKSALVALAAHASDPTEAERLKHLASPAGK

DEYSKWVVESQRSLLEVMAEFPSAKPPLGVFEAGVAPRLQPRPYSISSSPKIAETRIHVTCALV

YEKMPTGRIHKGVCSTWMKNAVPYEKSEKLFLGRPIFVRQSNFKLPSDSKVPIIMIGPGTGLAP

FRGFLQERLALVESGVELGPSVIFFGCRNRRMDFIYEEELQRFVESGALAELSVAFSREGPTKE

-continued

YVQHKMMDKASDIWNMISQGAYLYVCGDAKGMARDVHRSLHTIAQEQGSMDSTKAEGFVKNLQT

SGRYLRDVW

Stevia rebaudiana CPR2 (SrCPR2)
(SEQ ID NO: 96)
MAQSESVEASTIDLMTAVLKDTVIDTANASDNGDSKMPPALAMMFEIRDLLLILTTSVAVLVGC

FVVLVWKRSSGKKSGKELEPPKIVVPKRRLEQEVDDGKKKVTIFFGTQTGTAEGFAKALFEEAK

ARYEKAAFKVIDLDDYAADLDEYAEKLKKETYAFFFLATYGDGEPTDNAAKFYKWFTEGDEKGV

WLQKLQYGVFGLGNRQYEHFNKIGIVVDDGLTEQGAKRIVPVGLGDDDQSIEDDFSAWKELVWP

ELDLLLRDEDDKAAATPYTAAIPEYRVVFHDKPDAFSDDHTQTNGHAVHDAQHPCRSNVAVKKE

LHTPESDRSCTHLEFDISHTGLSYETGDHVGVYCENLIEVVEEAGKLLGLSTDTYFSLHIDNED

GSPLGGPSLQPPFPPCTLRKALTNYADLLSSPKKSTLLALAAHASDPTEADRLRFLASREGKDE

YAEWVVANQRSLLEVMEAFPSARPPLGVFFAAVAPRLQPRYYSISSSPKMEFNRIHVTCALVYE

KTPAGRIHKGICSTWMKNAVPLTESQDCSWAPIFVRTSNFRLPIDPKVPVIMIGPGTGLAPFRG

FLQERLALKESGTELGSSILFFGCRNRKVDYIYENELNNFVENGALSELDVAFSRDGPTKEYVQ

HKMTQKASEIWNMLSEGAYLYVCGDAKGMAKDVHRTLHTIVQEQGSLDSSKAELYVKNLQMSGR

YLRDVW

Stevia rebaudiana CPR3 (SrCPR3)
(SEQ ID NO: 97)
MAQSNSVKISPLDLVTALFSGKVLDTSNASESGESAMLPTIAMIMENRELLMILTTSVAVLIGC

VVVLVWRRSSTKKSALEPPVIVVPKRVQEEEVDDGKKKVTVFFGTQTGTAEGFAKALVEEAKAR

YEKAVFKVIDLDDYAADDDEYEEKLKKESLAFFFLATYGDGEPTDNAARFYKWFTEGDAKGEWL

NKLQYGVFGLGNRQYEHFNKIAKVVDDGLVEQGAKRLVPVGLGDDDQCIEDDFTAWKELVWPEL

DQLLRDEDDTTVATPYTAAVAEYRVVEHEKPDALSEDYSYTNGHAVHDAQHPCRSNVAVKKELH

SPESDRSCTHLEFDISNTGLSYETGDHVGVYCENLSEVVNDAERLVGLPPDTYFSIHTDSEDGS

PLGGASLPPPFPPCTLRKALTCYADVLSSPKKSALLALAAHATDPSEADRLKFLASPAGKDEYS

QWIVASQRSLLEVMEAFPSAKPSLGVFFASVAPRLQPRYYSISSSPKMAPDRIHVTCALVYEKT

PAGRIHKGVCSTWMKNAVPMTESQDCSWAPIYVRTSNFRLPSDPKVPVIMIGPGTGLAPFRGFL

QERLALKEAGTDLGLSILFFGCRNRKVDFIYENELNNFVETGALSELIVAFSREGPTKEYVQHK

MSEKASDIWNLLSEGAYLYVCGDAKGMAKDVHRTLHTIVQEQGSLDSSKAELYVKNLQMSGRYL

RDVW

Artemisia annua CPR (AaCPR)
(SEQ ID NO: 98)
MAQSTTSVKLSPFDLMTALLNGKVSFDTSNTSDTNIPLAVFMENRELLMILTTSVAVLIGCVVV

LVWRRSSSAAKKAAESPVIVVPKKVTEDEVDDGRKKVTVFFGTQTGTAEGFAKALVEEAKRRYE

LVWRRSSSAAKKAAESPVIVVPKKVTEDEVDDGRKKVTVFFGTQTGTAEGFAKALVEEAKARYE

KAVFKVIDLDDYAAEDDEYEEKLKKESLAFFFLATYGDGEPTDNAARFYKWFTEGEEKGEWLDK

LQYAVFGLGNRQYEHFNKIAKVVDEKLVEQGAKRLVPVGMGDDDQCIEDDETANKELVWPELDQ

LLRDEDDTSVATPYTAAVAEYRVVFHDKPETYDQDQLTNGHAVHDAQHPCRSNVAVKKELHSPL

SDRSCTHLEFDISNTGLSYETGDHVGVYVENLSEVVDEAEKLIGLPPHTYFSVHADNEDGTPLG

GASLPPPFPPCTLRKALASYADVLSSPKKSALLALAAHATDSTEADRLKFLASPAGKDEYAQWI

VASHRSLLEVMEAFPSAKPPLGVFFASVAPRLQPRYYSISSSPRFAPNRIHVTCALVYEQTPSG

-continued

RVHKGVCSTWMKNAVPMTESQDCSWAPIYVRTSNFRLPSDPKVPVIMIGPGTGLAPFRGFLQER

LAQKEAGTELGTAILFFGCPURKVDFIYEDELNNFVETGALSELVTAFSREGATKEYVQHKMTQ

KASDIWNLLSEGAYLYVCGDAKGMAKDVHRTLHTIVQEQGSLDSSKAELYVKNLQMAGRYLRDV

A

CPR (PgCPR)
(SEQ ID NO: 99)
MAQSSSGSMSPFDFMTAIIKGKMEPSNASLGAAGEVTAMILDNRELVMILTTSIAVLIGCVVVF

IWRRSSSQTPTAVQPLKPLLAKBTESEVDDGKQKVTIFFGTQTGTAEGFAKALADEAKARYDKV

TFKVVDLDDYAADDEEYEEKLKKETLAFFFLATYGDEPTDNAARFYKWFLEGKERGEWLQNLK

FGVFGLGNRQYEHFNKIAIVVDEILAEQGGKRLISVGLGDDDQCIEDDFTAWRESLWPELDQLL

RDEDDTTVSTPYTAAVLEYRVVFHDPADAPTLEKSYSNANGHSVVDAQHPLRANVAVRRELHTP

ASDRSCTHLEFDISGTGIAYETGDHVGVYCENLAETVEEALELLGLSPDTYFSVHADKEDGTPL

SGSSLPPPFPPCTLRTALTLHADLLSSPKKSALLALAAHASDPTEADRLRHLASPAGKDEYAQW

IVASQRSLLEVMAEFPSAKPPLGVFFASVAPRLQPRYYSISSSPRIAPSRIHVTCALVYEKTPT

GRVHKGVCSTWMKNSVPSEKSDECSWAPIFVRQSNFKLPADAKVPIIMIGPGTGLAPFRGFLQE

RLALKEAGTELGPSILFFGCRNSKMDYIYEDELDNFVQNGALSELVLAFSREGPTKEYVQHKMM

EKASDIWNLISQGAYLYVCGDAKGMARDVHRTLHTIAQEQGSLDSSKAESMVKNLQMSGRYLRD

VW

Camptotheca acuminate CaCPR
(SEQ ID NO: 201)
MAQSSSVKVSTFDLMSAILRGRSMDQTNVSFESGESPALAMLIENRELVMILTTSVAVLIGCFV

VLLWRRSSGKSGKVTEPPKPLMVKTEPEPEVDDGKKKVSIFYGTQTGTAEGFAKALAEEAKVRY

EKASFKVIDLDDYAADDEEYEEKLKKETLTFFFLATYGDEPTDNAARFYKWFMEGKERGDWLK

NLHYGVFGLGNRQYEHFNRIAKVVDDTIAEQGGKRLIPVGLGDDDQCIEDDFAAWRELLWPELD

QLLQDEDGTTVATPYTAAVLEYRVVFHDSPDASLLDKSFSKSNGHAVHDAQHPCRANVAVRREL

HTPASDRSCTHLEFDISGTGLVYETGDHVGVYCENLIEVVEEAEMLLGLSPDTFFSIHTDKEDG

TPLSGSSLPPPFPPCTLRRALTQYADLLSSPKKSSLLALAAHCSDPSEADRLRHLASPSGKDEY

AQWVVASQRSLLEVMAEFPSAKPPIGAFFAGVAPRLQPRYYSISSSPRMAPSRIHVTCALVFEK

TPVGRIHKGVCSTWMKNAVPLDESRDCSWAPIFVRQSNFKLPADTKVPVLMIGPGTGLAPFRGF

LQERLALKEAGAELGPAILFFGCRNRQMDYIYEDELNNFVETGALSELIVAFSREGPKKEYVQH

KMMEKASDIWNMISQEGYIYVCGDAKGMARDVHRTLHTIVQEQGSLDSSKTESMVKNLQMNGRY

LRDVW

Non-heme iron oxidase
Acetobacter pasteurianus subsp. ascendens (ApGA2ox)
(SEQ ID NO: 100)
MSVSKTTETFTSIPVIDISKLYSSDLAERKAVAEKLGDAARNIGFLYISGHNVSADLIEGVRKA

ARDFFAEPFEKKMEIYIGTSATHKGFVPEGEEVYSAGRPDHKEAFDIGYEVPANHPLVQAGTPL

LGPNNWPDIPGFRSAAEAYYRTVFDLGRTLFRGFALALGLNESYFOTVANFPPSKLRMIHYPYD

ADAODAPGIGAHTDYECFTILLADKPGLEVMNGNGDWIDAPPIPGAFVVNIGDMLEVMTAGEFV

ATAHRVRKVSEERYSFPLFYACDYHTQIRPLPAFAKKIDASYETITIGEHMWAQALQTYQYLVK

KVEKGELKLPKGARKTATFGHFKRNSAA

Cucurbita maxima (CmGA2ox)
(SEQ ID NO: 101)
MAAASSFSAAFYSGIPLIDLSAPDAKQLIVKACEELGFFKVVKHGVPMELISSLESESTKFFSL

PLSEKQRAGPPSPFGYGNKQIGRNGDVGWVEYLLLNTHLESNSDGFLSMFGQDPQKLRSAVNDY

-continued

ISAvRNMAGEILELMAEGLKIQQRNVFSKLVMDEQSDSVFRVNHYPPCPDLQALKGTNMIGFGE

HTDPQIISVLRSNNTSGFQISLADGNWISVPPDHSSFFINVGDSLQVMTNGRFKSVKHRVLTNS

SKSRVSMIYFGGPPLSEKIAPLASLMQGEERSLYKEFTWFEYKRSAYNSRLADNRLVPFERIAA

S

Dendrobium catenatum (DcGA3ox)
(SEQ ID NO: 102)
MPSLSKEHFDLYSAFHVPETHAWSSSHLHDHPIAGDGATIPVIDISDPDAASMVGGACRSWGVF

YATSHGIPADLLHQVESHARRLFSLPLHRKLQTAPRDGSLSGYGRPPISAFFPKLMWSEGFTLA

GHDDHLAVTSQLSPFDSLSFCEVMEAYRKEMKKLAGRLFRLLILSLGLEEEEMGQVGPLKELSQ

AADAIQLNSYPTCPEPERAIGMAAHTDSAFLTVLHQTDGAGGLQVLRDQDESGSARWVDVLPRP

DCLVVNVGDLLHILSNGRFKSVRHRAVVNRADHRISAAYFIGPPAHMKVGSITKLVDMRTGPMY

RPVTWPEYLGIRTRLFDKALDSVKFQEKELEKD

Cucurbita maxima (CmGA3ox)
(SEQ ID NO: 103)
MATTIADVFKSFPVHIPAHKNLDFDSLHELPDSYAWIQPDSFPSPTHKHHNSILDSDSDSVPLI

DLSLPNAAALIGNAFRSWGAFQVINHGVPISLLQSIESSADTLFSLPPSHKLKAARTPDGISGY

GLVRISSFFPKRMWSEGFTIVGSPLDHFRQLWPHDYHKHCEIVEEYDREMRSLCGRLMWLGLGE

LGITRDDMKWAGPDGDFKTSPAATQFNSYPVCPDPDRAMGLGPHTDTSLLTTVYQSNTRGLQVL

REGKRWVTVEPVAGGLWQVGDLLHILTNGLYPSALHQAWNRTRKRLSVAYVFGPPESAEISP

LKKLLGPTQPPLYRPVTWTEYLGKKAEHFNNALSTVRLCAPITGLLDVNDHSRVKVG

Cucurbita maxima (CmGA20ox)
(SEQ ID NO: 104)
MHVVTSTPEARHDGAPLVFDASVLRHQHNIPKQFIWPDEEKPAATCPELEVPLIDLSGFLSGEK

DAAAEAVRLVGEACEKHGFFLVVNHGVDRKLIGEAHKYMDEFFELPLSQKQSAQRKAGEHCGYA

SSFTGRFSSKLPWKETLSFRFAADESLNNLVLHYLNDKLGDQFAKFGRVYQDYCEAMSGLSLGI

MELLGKSLGVEEQCFKNFFKDNDSIMRLNFYPPCQKPHLTLGTGPHCDPTSLTILHQDQVGGLQ

VFVDNQWRLITPNFDAFVVN1GDTFMALSNGRYKSCLHRAVVNSERTRKSLAFFLCPRNDKVVR

PPRELVDTONPRRYPDFTWSMLLRFTQTHYRADMKTLEAFSAWLQQEQQEQQEQQFNI

Agapanthus praecox subsp. orientalis (ApoGA20ox)
(SEQ ID NO: 105)
MVLQPFVFDAALLRDEHNIPTQFIWPEEDKPSPDASEELILPFIDLKAFLSGDPDSPFQVSKQV

GEACESLGAFQVTNHGIDFDLLEEAHSCIQKFFSMPLCERQRALRKAGESYGYASSFTGRFCSK

LPWKETLSFRYSSSSSDIVQNYFVRTLGEEFRHFGEVYQKYCESMSKLSLMIMEVLGLSLGVGR

MHFREFFEGNDSTMRLNYYPPCKKPDLTLGTGPHCDPTSLTILHQDDVSGLQVFTGGKWLTVRP

KTDAFVVNIGDTFTALSNGRYKSCLHRAVVNSKTARKSLAFFLCPAMNKIVRPPRELVDIDHPR

AYPDFTWSALLEFTQKHYRADMQTLNEFSKYILQAQGTLHK

Arabidopsis thaliana (AtFH)
(SEQ ID NO: 106)
MAPGTLTELAGESKLNSKFVRDEDERPKVAYNVFSDEIPVISLAGIDDVDGKRGEICRQIVEAC

ENWGIFQVVDHGVDTNLVADMTRLARDFFALPPEDKLRFDMSGGKKGGFIVSSHLQGEAVQDWR

BIVTYFSYPVRNRDYSRWPDKPEGWVKVTEEYSERLMSLACKLLEVLSEAMGLBKESLTNACVD

MDQKIVVNYYPKCPQPDLTLGLKRHTDPGTTTLLLQDQVGGLQATRDNGKTWITVQPVEGAFVV

NLGDHGHFLSNGRFKNADHQAVVNSNSSRLSIATFQNPAPDATVYPLKVREGEKAILEEPITFA

EMYKRKMGRDLELARLKKLAKEERDHKEVDKPVDQIEA

-continued

*Chrysosplenium americanum* (CaF6H)

(SEQ ID NO: 107)

QEKTLNSRFVARDEDSLERPKVSAIYNGSFDEIPVLISLAGIDMTGAGTDAAARRSEICRKIVE

ACEDWGIFGEIDDDHGKRAEICDKIVKACEDWGVFQPDEKLESVMSAAKKGDFVVDHGVDAEVI

SQWTTFAKPTSHTQFETETTRDFPNKPEGWKATTEQYSRTLMGLACKLLGVISEAMGLEKEALT

KACVDMDQKVVVNYYPKCPQPDLTLGLKRHTDPGTITLLLQDQVGGLQATRDGGKTWITVQPVK

DNGWILLHIGDSNGHRHGHFLSNGRFKSHQAYRYRRPTRGSPTFGTKVSNYPPCPEQSLVRPPA

GRPYGRALNALDAKKLASAKQQLESAAILLISELAVAYIILAILPSSEIIAEEGYL

*Datura stramonium* (DsH6H)

(SEQ ID NO: 108)

MATFVSNWSTNNVSESFIAPLEKRAEKDVALGNDVPIIDLQQDHLLIVQQITKACQDFGLFQVI

NHGVPEKLMVEAMEVYKEFFALPAEEKEKFQPKGEPAKFELPLEQKAKLYVEGERRCNEEFLYW

KDTLAHGCYPLHEELLNSWPEKPPTYRDVIAKYSVEVRKLTMRILDYICEGLGLKLGYFDNELT

QIQMLLANYYPSCPDPSSTIGSGGHYDGNLITLLQQDLVGLQQLIVKDDRWIAVEPIPTAFVVN

LGLTLKVMSNEKFEGSIHRVVTHPTRNRISIGTLIGPDYSCTIEPIKELLSQENPPLYKPYPYA

KFAEIYLSDKSDYDAGVKPYKINQFPN

*Arabidopsis thaliana* (AtH6DH)

(SEQ ID NO: 109)

MENHTTMKVSSLNCIDLANDDLNHSVVSLKQACLDCGFFYVINHGISEEFMDDVFEQSKKLEAL

PLEEKMKVLRNEKHRGYTPVLDELLDPKNQINGDHKEGYYIGIEVPKDDPHWDKPFYGPNPWPD

ADVLPGWRETMEKYHQEALRVSMAIARLLALALDLDVGYFDRTEMLGKPIATMRLLRYQGISDP

SKGIYACGAHSDFGMMTLLATDGVMGLQICKDKNAMPQKWEYVPPTKGAFTVNLGDMLERWSNG

FFKSTLHRVLGNGQERYSIPFFVEPNHDCLVECLPTCKSESELPKYPPIKCSTYLTQRYEETHA

NLSIYHQQT

*Solanuni lycopersicum* (S1F35H)

(SEQ ID NO: 110)

MALRINELFVAAIIYIIVHIIISKLITTVRERGRRLPLPPGPTGWPVIGALPLLGSMPHVALAK

MAKKYGPIMYLKVGTCGMVVASTPNAAKAFLKTLDINFSNRPPNAGATHLAYNAQDMVFAPYGP

RWKLLRKLSNLHMLGGKALENWANVRANELGHMLKSMFDASQDGECVVIADVLTFAMANMIGQV

MLSKRVFVEKGVEVNEFKNMVVELMTVAGYFNIGDFIPKLAWMDIQGIEKGMKNLHKKFDDLLT

KMFDEHFATSNERKFNPDFLDVVMANRDNSEGERLSTTNIKALLLNLFTAGTDTSSSVIEWALA

EMMKNPKIFEKAQQEMDQVIGKNRRLIESDIPNLPYLRAICKETFRKHPSTPLNLPRVSSEPCT

VDGYYIPKNTRLSVNIWAIGRDPDVWENPLEFTPERFLSGKNAKIEPRGNDFELIPFGAGRRIC

AGTRMGIVMVEYILGTLVHSFDWKLPNNVIDINMEESFGLALQKAVPLEAMVTPRLSLDVYRC

D4H (SEQ ID NO: 111)

MPKSWPIVISSHSFCFLPNSEQERKMKDLNFHAATLSEEESLRELKAFDETKAGVKGIVDTGIT

KIPRIFIDQPKNLDRISVCRGKSDIKIPVINLNGLSSNSEIRREIVEKIGEASEKYGFFQIVNH

GIPQDVMDEMVDGVRKFHEQDDQIKRQYYSRDRFNKNFLYSSNYVLIFGIACNWRDTMECIMNS

NQFDPQEFPDVCRDILMKYSNYVRNLGLILFELLSEMiGLKPNHLSEMDCAEGLILLGHYYPAC

PQPELTFGTSKKSDSGFLTILKQDQIGGLQILLENQWIDVPFIPGALVINIADLLQLITNDKFK

SVEHRVLANKVGPRISVAVAFGIKTQTQEGVSPRLYGPIKELISSENPPIYKSVTVKDFITIRF

AKRFDDSSSLSPFRLNN

*Catharanthus roseus* (crD4Hlike)

(SEQ LD NO: 112)

MKELNNSEEELKAFDDTKAGVKALVDSGITEIPRIFLDHPTNLDQISSKDREPKFKKNIPVIDL

DGISTNSEIRREIVEKIREASEKWGFHQIVNHGIPQEVMDDMIVGIRRFHEQDNEIKKQFYTRD

-continued

RTKSFRYTSNFVLKPKIACNWRDTFECTMAPHQPNPQDLPDICRDIMMKYISYTRNLGLTLFEL

LSEALGLKSNRLKDMHCDEGVELVGHYYPACPQPELTLGTSKHTDTGFLTMLQQDQIGGLQVLY

ENHQWVDVPFIPGALIINIGDFLQIISNDKFKSAPHRVLANKNGPRISTASVFMPNFLESAEVR

LYGPIKELLSEENPPIYEQITAKDYVTVQFSRGLDGDSFLSPFMLNKDNMEK

Zea mays (ZmBX6)
(SEQ ID NO: 113)
MAPTTATKDDSGYGDERRRELQAFDDTKLGVKGLVDSGVKSIPSIFHHPPEALSDIISPAPLPS

SPPSGAAIPVVDLSVTRREDLVEQVRHAAGTVGFFWLVNHGVAEELMGGMLRGVRGFNEGPVEA

KQALYSRDLARNLRFASNFDLFKAAAADWRDTLFCEVAPNPPPREELPEPLRNVMLEYGAAVTK

LARFVFELLSESLGMPSDHLYEMECMQNLNVVCQYYPPCPEPHRTVGVKRHTDPGFFTILLQDG

MGGLQVRLGNNGQSGGCWVDIAPRPGALMVNIGDLLQLVTNDRFRSVEHRVFANKSSDTARVSV

ASFFNTDVRRSERMYGPIPDPSKPPLYRSVRARDFIAKFNTIGLDGRALDHFRL

Hordeum vulgare subsp. vulgare (HVIDS2)
(SEQ ID NO: 114)
MAKVMNLTPVHASSIPDSFLLPADRLHPATTDVSLPIIDMSRGRDEVRQAILDSGKEYGFIQVV

NHGISEPMLHEMYAVCHEFFDMPAEDKAEFFSEDRSERNKLFCGSAFETLGEKYWIDVLELLYP

LPSGDTKDWPHKPOMLREVVGNYTSLARGVAMEILRLLCEGLGLRPDFFVGDISGGRVVVDINY

YPPSPNPSRTLGLPPHCDRDLMTVLLPGAVPGLEIAYKGGWIKVQPVPNSLVINFGLOLEVVTN

GYLKAVEHRAATNFAEPRLSVASFIVPADDCVVGPAEEFVSEDNPPRYRTLTVGEFKRKHNVVN

LDSSINQIININNNQKGI

Hordeum vulgare subsp. vulgare (HvIDS3)
(SEQ ID NO: 115)
MENILHATPAPVSLPESFVFASDKVPPATKAVVSLPIIDLSCGRDEVRRSILEAGKELGFEQVV

NKGVSKQVMRDMEGMCEQFFHLPAADKASLYSEERHKPNRLFSGATYDTGGEKYWRDCLRLACP

FPVDDSINEWPDTPKGLRDVIEKFTSQTRDVGKELLRLLCEOMGIRADYFEGDLSGGNVILNIN

HYPSCPNPDKALGQPPHCDRNLITLLLPGAVNGLEVSYKGDWIKVDPAPNAFVVNFGQQLEVVT

NGLLKSIEHRaMTNSALARTSVATFIMPTQECLIGPAKEFLSKENPPCYRTTMFRDFMRIYNVV

KLGSSLNLTTNLKNVQKEI

Uridine diphosphate dependent glycosyltransferase (UGT)
Siraitia grosvenorii UGT720-269-1
(SEQ ID NO: 116)
MEDRNAMDMSRIKYEPQPLRPASMVQPRVLLFPFPALGHVKPFLSLAELLSDAGIDVVFLSTEY

NHRRISNTEALASRFPTLHFETIPDGLPPNESRALADGPLYFSMREGTKPRFRQLIQSLNDGRW

PITCLITDIMLSSPIEVAEEFGIPVIAFCPCSARYLSIHFEIPKLVEEGQIPYADDDPIGELQG

VPLFEGLLRRNHLPGSWSDKSADISFSHGLINQTLAAGRASALILNTFDELEAPFLTHLSSIFN

KIYTIGPLHALSKSRLGDSSSSASALSGFWKEDRACMSWLDCQPPRSVVFVSFGSTMKMKADEL

REFWYGLVSSGKPFLCVLRSDVVSGGEAAELIEQMAEEEGAGGKLGMVVEWAAQEKVLSHPAVG

GFLTHCGWNSTVESIAAGVPMMCWPILGDQPSNATWIDRVWKIGVERNNREWDRLTVEKMVRAL

MEGQKRVEIQRSMEKLSKLANEKVVRGINLHPTISLKKDTPTTSEHPRHEFENMRCMNYEMLVG

NAIKSPTLTKK

Siraitia grosvenorii UGT94-289-3
(SEQ ID NO: 117)
MTIFFSVEILVLGLAEFAAIAMDAAQQGDTTTILMLPWLGYGHLSAFLELAKSLSRRNFHIYFC

STSVNLDAIKPKLPSSFSDSIQFVELHLPSSPEFPPHLHTTNGLPPTLMPALHQAFSMAAQHFE

SILQTLAPHLLIYDSLQPWAPRVASSLKIPAINFNTTGVFVISQGLHPIHYPHSKFPFSEFVLH

NHWKAMYSTADGASTERTRKRGEAFLYCLHASCSVILINSFRELEGKYMDYLSVLLNKKVVPVG

-continued

PLVYEPNQDGEDEGYSSIKNWLDKKEPSSTVFVSFGSEYFPSKEEMEEIAHGLEASEVNFIWVV

RFPQGDNTSGIEDALPKGFLERAGERGMVVKGWAPQAKILKHWSTGGFVSHCGWNSVMESMMFG

VPIIGVPMHVDQPFNAGLVEEAGVGVEAKRDPDGKIQRDEVAKLIKEVVVEKTREDVRKKAREM

SEILRSKGEEKFDEMVAEISLLLKI

*Siraitia grosvenorii* UGT74-345-2

(SEQ ID NO: 118)

MDETTVNGGRRASDVVVFAFPRHGHMSPMLQFSKRLVSKGLRVTFLITTSATESLRLNLPPSSS

LDLQVISDVPESNDIATLEGYLRSFKATVSKTLADFIDGIGNPPKFIVYDSVMPWVQEVARGRG

LDAAPFFTQSSAVNHILNHVYGGSLSIPAPENTAVSLPSMPVLQAEDLPAFPDDPEVVMNFMTS

QFSNFQDAKWIFFNTFDQLECKKQSQVVNWMADRWPIKTVGPTIPSAYLDDGRLEDDRAFGLNL

LKPEDGKNTRQWQWLDSKDTASVLYISFGSLAILQEEQVKELAYFLKDTNLSFLWVLRDSELQK

LPHNFVQETSERGLVVNWCSQLQVLSHRAVSCFVTHCGWNSTLEALSLGVPMVAIPQWVDQTTN

AKFVADVWRVGVRVKKKDERIVTKEELEASIRQVVQGEGRNEFKHNAIKNKKLAKEAVDEGGSS

DKNIEEFVKTIA

*Siraitia grosvenorii* UGT75-281-2

(SEQ ID NO: 119)

MGDNGDGGEKKELKENVKKGKELGRQAIGEGYINPSLQLARRLISLGVNVTFATTVLAGRRMKN

KTHQTATTPGLSFATFSDGFDDETLKPNGDLTHYFSELRRCGSESLTHLITSAANEGRPITFVI

YSLLLSWAADIASTYDIPSALFFAQPATVLALYFYYFHGYGDTICSKLQDPSSYIELPGLPLLT

SQDMPSFFSPSGPHAFILPPMREQAEFLGRQSQPKVLVNTFDALEADALRAIDKLKMLAIGPLI

PSALLGGNDSSDASFCGDLFQVSSEDYIEWLNSKPDSSVVYISVGSICVLSDEQEDELVHALLN

SGHTFLWVKRSKENNEGVKQETDEEKLKKLEEQGKMVSWCRQVEVLKHPALGCFLTHCGWNSTI

ESLVSGLPVVAFPQQIDQATNAKLIEDVWKTGVRVKANTEGIVEREEIRRCLDLVMGSRDGQKE

EIERNAKKWKELARQAIGEGGSSDSNLKTFLWEIDLEI

*Siraitia grosvenorii* UGT720-269-4

(SEQ ID NO: 120)

MAEQAHDLLHVLLFPFPAEGHIKPFLCLAELLCNAGFHVTFLNTDYNHRRLHNLHLLAARFPSI

HFESISDGLPPDQPRDILDPKFFISICQVTKPLFRELLLSYKRISSVQTGRPPITCVITDVIFR

FPIDVAEELDIPVFSFCTFSAREMFLYEWIPKLIEDGQLPYPNGNINQKLYGVAPEAEGLLRCK

DLPGHWAFADELKDDQLNFVDQTTASSRSSGLILNTFDDLEAPFLGRLSTIFKKIYAVGPIHSL

LNSHHCCLWKEDHSCLAWLDSRAAKSVVFVSFGSLVKITSRQLMEFWHGLLNSGKSFLFVLRSD

VVEGDDEKQVVKEIYETKAEGKWLVVGWAPQEKVLAHEAVGGFLTHSGWNSILESIAAGVPMIS

CPKIGDQSSNCTWISKVWKIGLEMEDRYDRVSVETMVRSIMEQEGEKMQKTIAELAKQAKYKVS

KDGTSYQNLECLIQDIKKLNQIEGFINNPNFSDLLRV

*Siraitia grosvenorii* UGT94-289-2

(SEQ ID NO: 121)

MDAQQGHTTTILMLPWVGYGHLLPFLELAKSLSRRKLFHIYFCSTSVSLDAIKPKLPPSISSDD

SIQLVELRLPSSPELPPHLHTTNGLPSHLMPALHQAFVMAAQHFQVILQTLAPHLLIYDILQPW

APQVASSLNIPAINFSTTGASMLSRTLHPTHYPSSKFPISEEVLHNHWRAMYTTADGALTEEGH

KIEETLANCLHTSCGVVLVNSFRELETKYIDYLSVLLNKKVVPVGPLVYEPNQEGEDEGYSSIK

NWLDKKEPSSTVFVSFGTEYFPPSKEEMEEIAYGLELSEVNFIWVLRFPQGDSTSTIEDALPKGF

LERAGERAMVVKGWAPQAKILKHWSTGGLVSHCGWNSMMEGMMFGVPIIAVPMHLDQPFNAGLV

EEAGVGVEAKRDSDGKIQREEVAKSIKEVVIEKTREDVRKKAREMDTKHGPTYFSRSKVSSFGR

LYKINRPTTLTVGRFWSKQIKMKRE

-continued

*Siraitia grosvenorii* UGT94-289-1

(SEQ ID NO: 122)

MDAQRGHTTTILMFPWLGYGHLSAFLELAKSLSRRNFHYFCSTSVNLDAIKPKLPSSSSSDSI

QLVELCLPSSPDQLPPHLHTTNALPPHLMPTLHQAFSMAAQHFAAILHTLAPHLLIYDSFQPWA

PQLASSLNIPAINFNTTGASVLTRMLHATHYPSSKFPISEFVLHDYWKAMYSAAGGAVTKKDHK

IGETLANCLHASCSVILINSFRELEEKYMDYLSVLLNKKVVPVGPLVYEPNQDGEDEGYSSIKN

NLDKKEPSSTVFVSFGSEYFPSKEEMEEIAHGLEASEVHFTWVVRFPQGDNTSAIEDALPKGFL

ERVGERGMVVKGWAPQAKILKHWSTGGFVSHCGWNSVMESMMFGVPIIGVPMHLDQPFNAGLAE

EAGVGVEAKRDPDGKIQRDEVAKLIKEVVVEKTREDVRKKAREMSEILRSKGEEKMDEMVAAI8

LFLKI

*Momordica charantia* 1 (McUGT1)

(SEQ ID NO: 123)

MAQPQTQARVLVFPYPTVGHIKPFLSLAELLADGGLDVVFLSTEYNHRRIPNLEALASRFPTLH

FDTIPDGLPIDKPRVIIGGELYTSMRDGVKQRLRQVLQSYNDGSSPITCVICDVMLSGPIEAAE

ELGIPVVTFCPYSARYLCAHFVMPKLIEEGQIPFTDGNLAGEIQGVPLFGGLLRRDHLPGFWFV

KSLSDEVWSHAFLNQTLAVGRTSALIINTLDELEAPFLAHLSSTFDKIYPIGPLDALSKSRLGD

SSSSSTVLTAFWKEDQACMSWLDSQPPKSVIFVSFGSTMRMTADKLVEFNHGLVNSGTRFLCVL

RSDIVEGGGAADLIKQVGETGNGIVVEWAAQEKVLAHRAVGGFLTHCGWNSTMESIAAGVPMMC

WQIYGDQMINATWIGKVWKIGIERDDKWDRSTVEKMIKELMEGEKGAEIQRSMEKFSKLANDKV

VKGGTSFENLELIVEYLKKLKPSN

*Momordica charantia* 2 (McUGT2)

(SEQ ID NO: 124)

MAQPRVLLFPFPAMGHVKPFLSLAELLSDAGVEVVFLSTEYNHRRIPDIGALAARFPTLHFETI

PDGLPPDQPRVLADGHLYFSMLDGTKPRFRQLIQSLNGNPRPITCIINDVMLSSPIEVAEEFGI

PVIAFCPCSARFLSVHFFMPNFIEEAQIPYTDENPMGKIEEATVFEGLLRRKDLPGLWCAKSSN

ISFSHRFINQTIAAGRASALILNTFDELESPFLNHLSSIFPKIYCIGPLNALSRSRLGKSSSSS

SALAGFWKEDQAYMSWLESQPPRSVIFVSFGSTMKMEAWKLAEFWYGLVNSGSPFLEVFRPDCV

INSGDAAEVMEGRGRGMVVEWASQEKVLAHPAVGGFLTHCGWNSTVESIVAGVPMMCCPIVADQ

LSNATWIHKVWKTGTEGDEKWDRSTVEMMIKELMESQKGTEIRTSIEMLSKLANEKVVKGGTSL

NNFELLVEDIKTLRRPYT

*Momordica charantia* 3 (McUGT3)

(SEQ ID NO: 125)

MEQSDSNSDDHQHHVLLFPFPAKGHIKPFLCLAQLLCGAGLQVTFLNTDHNHRRIDDRHRRLLA

TQFPMLHFKSISDGLPPDHPRDLLDGKLIASMRRVTESLFRQLLLSYNGYGNGTNNVSNSGRRP

PISCVITDVIFSFPVEVAEELGIPVFSFATFSARFLFLYEWIPKLIQEGQLPFPDGKTNQELYG

VPGAEGIIRCKDLPGSWSVEAVAKNDPMNFVKQTLASSRSSGLILNTFEDLEAPFVTHLSNTFD

KIYTIGPIHSLLGTSHCGLWKEDYACLAWLDARPRKSVVFVSFGSLVKTTSRELMELWHGLVSS

GKSFLLVLRSDVVEGEDEEQVVKEILESNGEGKWLVVGWAPQEEVLAHEAIGGFLTHSGWNSTM

ESIAAGVPMVCWPKIGDQPSNCTWVSRVWKVGLEMEERYDRSTVARMARSMMEQEGKEMERRIA

ELAKRVKYRVGKDGESYRNLESLIRDIKITKSSN

*Momordica charantia* 4 (McUGT4)

(SEQ ID NO: 126)

MDAHQQAEHTTTILMLPWVGYGHLTAYLELAKALSRRNFHIYYCSTPVNIESIKPKLTIPCSSI

QFVELHLPSSDDLPPNLHTTNGLPSHLMPTLHQAFSAAAPLFEEILQTLCPHLLIYDSLQPWAP

KIASSLKIPALNFNTSGVSVIAQALHAIHHPDSKFPLSDFILHNYWKSTYTTADGCASEKTRRA

REAFLYCLNSSGNAILINTFRELEGEYIDYLSLLLNKKVIPIGPLVYEPNQDEDQDEEYRSIKN

-continued

NLDKKEPCSTVFVSFGSEYFPSNEEMEEIAPGLEESGANFIWVVRFPKLENRNGIIEEGLLERA

GERGMVIKEWAPQARILRHGSIGGFVSHCGWNSVMESIICGVPVIGVPMRVDQPYNAGLVEEAG

VGVEAKRDPDGKIQRHEVSKLIKQVVVEKTRDDVRKKVAQMSEILRRKGDEKIDEMVALISLLP

KG

*Momordica charantia* 5 (MCUGT5)
(SEQ ID NO: 127)
MDARQQAEHTTTILMLPWVGYGHLSAYLELAKALSRRNFHIYYCSTPVNIESIKPKLTIPCSSI

QFVELHLPFSDDLPPNLHTTNGLPSHLMPALHQAFSAAAPLFEAILQTLCPHLLIYDSLQPWAP

QIASSLKIPALNFNTTGVSVIARALHTTHHPDSKFPLSEIVLHNYWKATHATADGANPEKFRRD

LEALLCCLHSSCNAILINTFRELEGEYIDYLSLLLNKKVTPIGPLVYEPNQDEEQDEEYRSIKN

WLDKKEPYSTIFVSFGSEYFPSNEEMEEIARGLEESGANFIWVVRFHKLENGNGITEEGLLERA

GERGMVIQGWAPQARILRHGSIGGFVSHCGWNSVMESIICGVPVIGVPMGLDQPYNAGLVEEAG

VGVEAKRDPDGKIQRHEVSKLIKQVVVEKTRDDVRKKVAQMSEILRRKGDEKIDEMVALISLLL

KG

*Cucumis sativus*
(SEQ ID NO: 128)
MGLSPTDHVLLFPFPAKGHIKPFFCLAHLLCNAGLRVTFLSTEHHHQKLHNLTHLAAQIPSLHE

QSISDGLSLDHPRNLLDGQLFKSMPQVTKPLFRQLLLSYKDGTSPITCVITDLILRFPMDVAQE

LDIPvFCFSTFSARFLFLYFSIPKLLEDGQIPYPEGNSNQVLHGIPGAEGLLRCKDLPGYWSVE

AVANYNPMNFVNQTIATSKSHGLILNTFDELEVPFITNLSKIYKKVYTIGPIHSLLKKSVQTQY

BFWKEDHSCLAWLDSQPPRSVMFVSFGSIVKLKSSQLKEFWNGLVDSGKAFLLVLRSDALVEET

GEEDEKQKELVIKEIMETKEEGRWVIVNWAPQEKVLEHKAIGGFLTHSGWNSTLESVAVGVPMV

SWPQIGDQPSNATWLSKVWKIGVEMEDSYDRSTVESKVRSIMEHEDKKMENAIVELAKRVDDRV

SKEGTSYQNLQRLIEDIEGFKLN

*Cucurbita maxima* 1 (CmaUGT1)
(SEQ ID NO: 129)
MELSHTHHVLLFPFPAKGHIKPFFSLAQLLCNAGLRVTFLNTDHHRRIHDLNRLAAOLPTLHF

DSVSDGLPPDEPRNVFDGKLYESIRQVTSSLFRELLVSYNNGTSSGRPPITCVITDVMFRFPID

IAEELGIPVFTFSTFSARFLFLIFWIPKLLEDGQLRYPEQELHGVPGAEGLIRWKDLPGFWSVE

DVADWDPMNFVNQTLATSRSSGLILNTFDELEAPFLTSLSKIYKKIYSLGPINSLLKNFQSQPQ

YNLWKEDHSCMAWLDSQPRKSVVFVSFGSVVKLTSRQLMEFWNGLVNSGMPFLLVLRSDVIEAG

EEVVREIMERKAEGRWVIVSWAPQEEVLAHDAVGGFLTHSGWNSTLESLAAGVPMISWPQIGDQ

TSNSTWISKVWRIGLQLEDGFDSSTIETMVRSIMDQTMEKTVAELAERAKNRASKNGTSYRNFQ

TLIQDIINIIETHI

*Cucurbita maxima* 2 (CmaUGT2)
(SEQ ID NO: 130)
MDAQKAVDTPPTTVLMLPWIGYGHLSAYLELAKALSRRNFHVYFCSTPVNLDSIKPNLIPPPSS

IQFVDLHLPSSPELPPHLHTTNGLPSHLKPTLHQAFSAAAQHFEAILQTLSPHLLIYDSLQPWA

PRIASSLNIPAINFNTTAVSIIAHALHSVHYPDSKFPPFSDFVLHDYWKAKYTTADGATSEKIRR

GAEAFLYCLNASCDVVLVNSFRELEGEYMDYLSVLLKKKVVSVGPLVYEPSEGEEDEEYWRIKK

WLDEKEALSTVLVSFGSEYFPSKEEMEEIAHGLEESEANFIWVVRFPKGEESCRGIEEALPKGE

VERAGERAMVVKKWAPQGKILKHGSIGGFVSHCGWNSVLESIRFGVPVIGVPMHLDQPYNAGLL

EEAGIGVEAKRDADGKIQRDQVASLIKRVVVEKTREDIWKTVREMREVLRRRDDDMIDEMVAEI

SVVLKI

*Cucurbita maxima* 3 (CmaUGT3)

(SEQ ID NO: 131)

MSSNLFLKISIPFGRLRDSALNCSVFHCKLHLAIAIAMDAQQAANKSPTATTIEMLPWAGYGHL

SAYLELAKALSTRNFHIYFCSTPVSLASIKPRLIPSCSSIQFVELHLPSSDEFPPHLHTTNGLP

SRLVPTFHQAFSEAAQTFEAFLQTLRPHLLIYDSLQPWAPRIASSLNIPAINFFTAGAFAVSHV

LRAFHYPDSQFPSSDFVLHSRWKIKNTTAESPTQAKLPKIGEAIGYCLNASRCVILTNSFRELE

GKYIDYLSVILKKRVFPIGPLVYQPNQDEEDEDYSRIKNWLDRKEASSTVLVSFGSEFFLSKEE

TEAIAHGLEQSEANFIWGIRFPKGAKKNAIEEALPEGFLERAGGRAMVVEEWVPQGKILKHGSI

GGFVSHCGWNSAMESIVCGVPIIGIPMQVDQPFNAGILEEAGVGVEAKRDSDGKIQRDEVAKLI

KEVVVERTREDIRNKLEKINEILRSRREEKLDELATEISLLSRN

*Cucurbita moschata* 1 (CmoUGT1)

(SEQ ID NO: 132)

MELSPTHHLLLFPFPAKGHIKPFFSLAQLLCNAGARVTFLNTDHHHRRIHDLDRLAAQLPTLHE

DSVSDGLPPDESRNVFDGKLYESIRQVTSSLFRELLVSYNNGTSSGRPPITCVITDCMFRFPID

IAEELGIPVFTFSTFSARFLFLFFWIPKLLEDGQLRYPEQELHGVPGAEGLIRCKDLPGFLSDE

DVAHWKPINFVNQILATSRSSGLILNTFDELEAPFLTSLSKIYKKIYSLGPINSLLKNFQSQPQ

YNLWKEDHSCMAWLDSQPPKSVVFVSFGSVVKLTNRQLVEFWNGLVNSGKPFLLVLRSDVIEAG

EEVVRENMERKAEGRWMIVSWAPQEEVLAHDAVGGFLTHSGWNSTLESLAAGVPMISWTQIGDQ

TSNSTWVSKVWRIGLQLEDGFDSFTIETMVRSVMDQTMEKTVAELAERAKNRASKNGTSYRNFQ

TLIQDITNIIETHI

*Cucurbita moschata* 2 (CmoUGT2)

(SEQ ID NO: 133)

MDAQKAVDTPPTTVIMLPWIGYGHLSAYLELAKALSRRNFHVYFCSTPVNLDSIKPNLIPPPPS

IQFVDLHLPSSPELPPHLHTTNGLPSHLKPTLHQAFSAAAQHFEAILQTLSPHLLIYDSLQPWA

PRIASSLNIPAINFNTTAVSIIAHALHSVHYPDSKFPFSDFVLHDYWKAKYTTADGATSEKTRR

GVEAFLYCLNASCDVVLVNSFRELEGEYMDYLSVLLKKKVVSVGPLVYEPSEGEEDEEYWRIKK

WLDEKEALSTVLVSFGSEYFPPKEEMEEIAHGLEESEANFIWVVRFPKGEESSSRGIEEALPKG

FVERAGERAMWKKWAPQGKILKHGSIGGFVSHCGWNSVLESIRFGVPVIGAPMHLDQPYNAGL

LEEAGIGVEAKRDADGKIQRDQVASLIKQVVVEKTREDTWKKVREMREVLRRRDDDDMMIDEMV

AVISVVLKI

*Cucurbita moschata* 3 (CmoUGT3)

(SEQ ID NO: 134)

MDAQQAANKSPTASTIFMLPWVGYGHLSAYLELAKALSTRNFHVYFCSTPVSLASIKPRLIPSC

SSIQFVELHLPSSDEFPPHLHTTNGLPAHLVPTIHQAFAAAAQTFEAFLQTLRPHLLIYDSLQP

NAPRIASSLNIPAINFFTAGAFAVSHVLRAFHYPDSQFPSSDFVLHSRWKIKNTTAESPTQVKI

PKIGEAIGYCLNASRGVILTNSFRELEGKYIDYLSVILKKRVLPIGPLVYQPNQDEEDEDYSRI

KNWLDRKEASSTVLVSFGSEFFLSKEETEAIAHGLEQSEANFIWGIRFPKGAKKNAIEEALPEG

FLERVGGRAMVVEEWVPQGKILKHGNIGGFVSHCGWNSAMESIMCGVPVIGIPMQVDQPFNAGI

LEEAGVGVEAKRDSDGKIQRDEVAKLIKEVVVERTREDIRNKLEEINEILRTRREEKLDELATE

ISLLCKN

*Prunus persica*

(SEQ ID NO: 135)

MAMKQPHVIIFPFPLQGHMKPLLCLAELLCHAGLHVTYVNTHHNHQRLANRQALSTHFPTLHFE

SISDGLPEDDPRTLNSQLLIALKTSIRPHFRELLKTISLKAESNDTLVPPPSCIMTDGLVTFAE

DVAEELGLPILSFNVPCPRYLWTCLCLPKLIENGQLPFQDDDMNVEITGVPGMEGLLHRQDLPG

FCRVKQADHPSLQFAINETQTLKRASALILDTVYELDAPCISHMALMFPKIYTLGPLHALLNSQ

-continued

IGDMSRGLASHGSLWKSDLNCMTWLDSQPSKSIIYVSFGTLVHLTRAQVIEFWYGLVNSGHPFL

WVMRSDITSGDHQIPAELENGTKERGCIVDWVSQEEVLAHKSVGGFLTHSGWNSTLESIVAGLP

MICWPKLGDHYIISSTVCRQWKIGLQLNENCDRSNTESMVQTLMGSKREEIQSSMDAISKLSRD

SVAEGGSSHNNLEQLIEYIRNLQHQN

*Theobronia cacao*
(SEQ ID NO: 136)
MRQPHVLVLPFPAQGHIKPMLCLAELLCQAGLRVTELNTHHSHRRLNNLQDLSTREPTLHEESV

SDGLPEDHPRNLVHFMHLVHSIKNVTKPLLRDLLTSLSLKTDIPPVSCIIADGILSFAIDVAEE

LQIKVIIFRTISSCCLWSYLCVPKLIQQGELQFSDSDMGQKVSSVPEMKGSLRLHDRPYSFGLK

QLEDPNFQFFVSETQAMTRASAVIFNTFDSLEAPVLSQMIPLLPKVYTIGPLHALRKARLGDLS

QHSSFNGNLREADHNCITWLDSQPLRSVVYVSFGSHVVLTSEELLEFWHGLVNSGKRFLWVLRP

DIIAGEKDHNQIIAREPDLGTKEKGLLVDWAPQEEVLAHPSVGGFLTHCGWNSTLESMVAGVPM

LCWPKLPDQLVNSSCVSEVWKIGLDLKDMCDRSTVEKMVRALMEDRREEVMRSVDCISKLARES

VSHGGSSSSNLEMLIQELET

*Corchorus capsularis*
(SEQ ID NO: 137)
MDSKQKKMSVLMFPWLAYGHISPFLELAKKLSKRNFHTFFFSTPINLNSIKSKLSPKYAQSIQF

VELHLPSLPDLPPHYHTTNGLPPHLMNTLKKAFDMSSLQFSKILKTLNPDLLVYDFIQPWAPLL

ALSNKIPAVHFACTSAAMSSFSVHAFKKPCEDFPFPNIYVHGNFMNAKFNNMENCSSDDSISDQ

DRVLQCFERSTKIILVKTFEELEGKFMDYLSVLLNKKIVPTGPLTQDPNEDEGDDDERTKLLLE

WLNKKSKSSTVFVSFGSEYFLSKEEREEIAYGLELSKVNFIWVIRFPLGENKTNLEEALPQGFL

QRVSERGLVVENWAPQAKILQHSSIGGFVSHCGWSSVMESLKFGVPIIAIPMHLDQPLNARLVV

DVGVGLEVIRNHGSLEREEIAKLIKEVVLGNGNDGEIVRRKAREMSNHIKKKGEKDMDELVEEL

MLCKMKPNSCHLS

*Ziziphus jujube*
(SEQ ID NO: 138)
MMERQRSIKVLMFPWLAHGHISPFLELAKRLTDRNFQIYFCSTPVNLTSVKPKLSQKYSSSIKL

VELHLPSLPDLPPHYHTTNGLALNLIPTLKKAFDMSSSSFSTILSTIKPDLLIYDFLQPWAPQL

ASCMNIPAVNFLSAGASMVSFVLHSIKYNGDDHDDEFLTTELHLSDSMEAKFAEMTESSPDEHI

DRAVTCLERSNSLILIKSFRELEGKYLDYLSLSFAKKVVPIGPLVAQDTNPEDDSMDIINWLDK

KEKSSTVFVSFGSEYYLTNEEMEEIAYGLELSKVNFTWVVRFPLGQKMAVEEALPKGFLERVGE

KGMVVEDWAPQMKILGHSSIGGFVSHCGWSSLMESLKLGVPIIAMPMQLDQPINAKLVERSGVG

LEVKRDKNGRIEREYLAKVIREIVVEKARQDIEKKAREMSNIITEKGEEEIDNVVEELAKLCGM

*Vitis vinifera*
(SEQ ID NO: 139)
MDARQSDGISVLMFPWLAHGHISPFLQLAKKLSKRNFSIYFCSTPVNLDPIKGKLSESYSLSIQ

LVKLHLPSLPELPPQYHTTNGLPPHLMPTLKMAFDMASPNFSNILKTLHPDLLIYDFLQPWAPA

AASSLNTPAVQFLSTGATLQSFLAHRHRKPGIEFPFQEIHLPDYEIGRLNRFLEPSAGRISDRD

RANQCLERSSRFSLIKTFREIEAKYLDYVSDLTKKKMVTVGPLLQDPEDEDEATDIVEWLNKKC

EASAVFVSFGSEYFVSKEEMEEIAHGLELSNVDFIWVVRFPMGEKIRLEDALPPGFLHRLGDRG

MVVEGWAPQRKILGHSSIGGFVSHCGWSSVMEGMKFGVPIIAMPMHLDQPINAKLVEAVGVGRE

VKRDENRKLEREEIAKVIKEVVGEKNGENVRRKARELSETLRKKGDEEIDVVVEELKQLCSY

-continued

Juglans regia
(SEQ ID NO: 140)
MDTARKRIRVVMLPWLAHGHISPFLELSKKLAKRNFHIYFCSTPVNLSSIKPKLSGKYSRSIQL

VELHLPSLPELPPQYHTTKGLPPHLNATLKRAFDMAGPHFSNILKTLSPDLLIYDFLQPWAPAI

AASQNTPAINFLSTGAAMTSFVLHAMKKPGDEFPFPEIHLDECMKTRFVDLPEDHSPSDDHNHI

SDKDRALKCFERSSGFVMMKTFEELEGKYINFLSHLMQKKIVPVGPLVQNPVRGDHEKAKTLEW

LDKRKQSSAVFVSFGTEYFLSKEEMEEIAYGLELSNVNFTWVVRFPEGEKVKLEEALPEGFLQR

VGEKGMVVEGWAPQAKILMHPSIGGFVSHCGWSSVMESIDFGVPIVAIPMQLDQPVNAKVVEQA

GVGVEVKRDRDGKLEREEVATVIREVVMGNIGESVRKKEREMRDNIRKKGEEKMDGVAQELVQL

YGNGIKNV

Hevea brasiliensis
(SEQ ID NO: 141)
METLQRRKISVLMFPWLAHGHLSPELELSKKLNKRNEHVYFCSTPVNLDSIKPKLSAEYSFSIQ

LVELHLPSSPELPLHYHTTNGLPPHLMKNLKNAFDMASSSFFNILKTLKPDLLIYDFIQPWAPA

LASSLNIPAVNFLCTSMAMSCFGLHLNNQEAKFPFPGIYPRDYMRMKVFGALESSSNDIKDGER

AGRCMDQSFHLILAKTFRELEGKYIDYLSVKLMKKIVPVGPLVQDPIFEDDEKIMDHHQVIKWL

EKKERLSTVFVSFGTEYFLSTEEMEEIAYGLELSKAHFIWVVRFPTGEKINLEESLPKRYLERV

QERGKIVEGWAPQQKILRHSSIGGFVSHCGWSSIMESMKFGVPIIAMPMNLDQPVNSRIVEDAG

VGIEVRRNKSGELEREEIAKTIRKVVVEKDGKNVSRKAREMSDTIRKKGEEEIDGVVDELLQLC

DVKTNYLQ

Manihot esculenta
(SEQ ID NO: 142)
MATAQTRKISVLMFPWLAHGHLSPFLELSKKLANRNFHVYFCSTPVNLDSIKPKLSPEYHFSIQ

FVELHLPSSPELPSHYHTTNGLPPHLMKTLKKAFDMASSSFFNILKTLNPDLLIYDFLQPWAPA

LASSLNIPAVNFLCSSMAMSCFGLNLNKNKEIKFLFPEIYPRDYMEMKLFRVFESSSNQIKDGE

RAGRCIDQSFHVILAKTFRELEGKYIDYVSVKCNKKIVPVGPLVEDTIHEDDEKTMDHHHHHHD

EVIKWLEKKERSTTVFVSFGSEYFLSKEEMEEIAHGLELSKVNFIWVVRFPKGEKINLEESLPE

GYLERIQERGKIVEGWAPQRKILGHSSIGGFVSHCGWSSIMESMKLGVPIIAMPMNLDQPINSR

IVEAACVGIEVSRNQSGELEREEMAKTIRKVVVEREGVYVRRKAREMSDVLRKKGEEEIDGVVD

ELVQLCDMKTNYL

Cephalotus follicularis
(SEQ ID NO: 143)
MDLKRRSIRVLMLPWLAHGHISPFLELAKKLTNRNFLIYFCSTPINLNSIKPKLSSKYSFSIQL

VELHLPSLPELPPHYHTTNGLPLHLMNTLKTAFDMASPSFLNILKTLKPDLLICDHLQPWAPSL

ASSLNIPAIIFPTNSAIMMAFSLHHAKNPGEEFPFPSININDDMVKSINFLHSASNGLTDMDRV

LQCLERSSNTMLLKTFRQLEAKYVDYSSALLKKKIVLAGPLVQVPDNEDEKIEIIKWLDSRGQS

STVFVSFGSEYFLSKEEREDIAHGLELSKVNFIWVVRFPVGEKVKLEEALPNGEAERIGERGLV

VEGWAPQAMILSHSSIGGFVSHCGWSSMMESMKFGVPIIAMPMHIDQPLNARLVEDVGVGLBIK

RNKDGRFEREELARVIKEVLVYKNGDAVRSKAREMSEHIKKNGDQEIDGVADALVKLCEMKTNS

LNQD

Stevia rebaudiana UGT74G1
(SEQ ID NO: 144)
MAEQQKIKKSPHVLLIPFPLQGHINPFIQFGKRLISKGVKTTLVTTIHTLNSTLNHSNTTTTSI

EIQAISDGCDEGGFMSAGESYLETFKQVGSKSLADLIKKLQSEGTTIDAIIYDSMTEWVLDVAI

EFGIDGGSFFTQACVVNSLYYHVHKGLISLPLGETVSVPGFPVLQRWETPLILQNHEQIQSPWS

QMLFGQFANIDQARWVFTNSFYKLEEEVIEWTRKIWNLKVIGPTLPSMYLDKRLDDDKDNGFNL

-continued

YKANHHECMNWLDDKPKESVVYVAFGSLVKHGPEQVEEITRALIDSDVNFLWVIKHKEEGKLPE

NLSEVIKTGKGLIVAWCKQLDVLAHESVGCFVTHCGFNSTLEAISLGVPVVAMPQFSDQTTNAK

LLDEILGVGVRVKADENGIVRRGNLASCIKMIMEEERGVIIRKNAVKWKDLAKVAVHEGGSSDN

DIVEFVSELIKA

Stevia rebaudiana UGT76G1 (SEQ ID NO: 145)
MENKTETTVRRRRRIILFPVPFQGHINPTLQLANVLYSKGFSITIFHTNFNKPKTSNYPHFTFR

FILDNDPQDERISMLPTHGPLAGMRIPIINEHGADELRRELELLMLASEEDEEVSCLITDALWY

FAQSVADSLNLRRLVLMTSSLFNFHAHVSLPQFDELGYLDPDDKTRLEEQASGFPMLKVKDIKS

AYSNWQILKEILGKMIKQTKASSGVIWNSFKELEESELETVIREIPAPSFLIPLPKHLTASSSS

LLDHDRTVFQWLDQQPPSSVLYVSFGSTSEVDEKDFLEIARGLVDSKQSFLWVVRPGFVKGSTW

VEPLPDGFLGERGRIVKWVPQQEVLAHGAIGAFWTHSGWNSTLESVCEGVPMIFSDFGLDQPLN

ARYMSDVLKVGVYLENGWERGEIANAIRRVMVDEEGEYIRQNARVLKQKADVSLMKGGSSYESL

ESLVSYISSL

Stevia rebaudiana UGT85C2 (SEQ ID NO: 146)
MDAMATTEKKPHVIFIPFPAQSHIKAMLKLAQLLHHKGLQITEVNTDFIHNQFLESSGPHCLDG

APGFRFETIPDGVSHSPEASIPIRESLLRSIETNFLDRFIDLVTKLPDPPTCIISDGFLSVFTI

DAAKKLGIPVMMYWTLAACGFMGFYHIHSLIEKGFAPLKDASYLTNGYLDTVIDWVPGMEGIRL

KDFPLDWSTDLNDKVLMFTTEAPQRSHKVSHHIFHTFDELEPSIIKTLSLRYNHIYTIGPLQLL

LDQIPEEKKQTGITSLHGYSLVKEEPECFQWLQSKEPNSVVYVNFGSTTVMSLEDMTEFGWGLA

NSNHYFLWIIRSNLVIGENAVLPPELEEHIKKRGFIASWCSQEKVLKHPSVGGFLTHCGWGSTI

ESLSAGVPMICWPYSWDQLTNCRYICKEWEVGLEMGTKVKRDEVKRLVQELMGEGGHKMRNKAK

DWKEKARIAIAPNGSSSLNIDKMVKEITVLARN

Stevia rebaudiana UGT91D1 (SEQ ID NO: 147)
MYNVTYHQNSKAMATSDSIVDDRKQLHVATFPWLAEGHLLPFLQLSKLIAEKGHKVSFLSTTRN

IQRLSSHISPLINVVQLTLPRVQELPEDAEATTDVHPEDIQYLKKAVDGLQPEVTRFLEQHSPD

NIIYDFTHYWLPSIAASLGISRAYFCVITPWTIAYLAPSSDAMINDSDGRTTVEDLTTPPKWFP

FPTKVCWRKHDLARMEPYEAPGISDGYRMGMVFKGSDCLLFKCYHEFGTQWLPLLETLHQVPVV

PVGLLPPEIPGDEKDETWVSIKKWLDGKQKGSVVYVALGSEALVSQTEVVELALGLELSGLPFV

WAYRKPKGPAKSDSVELPDGFVERTRDRGLVWTSWAPQLRILSHESVCGFLTHCGSGSIVEGLM

FGHPLIMLPIFCDQPLNARLLEDKQVGIEIPRNEEDGCLTKESVARSLRSVVVENEGEIYKANA

RAISKIYNDTKVEKEYVSQFVDYLEKNARAVAIDHES

Stevia rebaudiana UGT91D2 (SEQ ID NO: 148)
MATSDSIVDDRKQLHVATFPWLAFGHILPYLQLSKLIAEKGHKVSFLSTTRNIQRLSSHISPLI

NVVQLTLPRVQELPEDAEATTDVHPEDIPYLKKASDGLQPEVTRFLEQHSPDWIIYDYTHYWLP

SIAASLGISRAHFSVTTPWAIAYMGPSADAMINGSDGRTTVEDLTTPPKWFPFPTKVCWRKHDL

ARLVPYKAPGISDGYRMGLVLKGSDCLLSKCYHEFGTQWLPLLETLHQVPVVPVGLLPPEVPGD

EKDETWVSIKKWLDGKQKGSVVYVALGSEVLVSQTEVVELALGLELSGLPFVWAYRKPKGPAKS

DSVELPDGFVERTRDRGLVWTSWAPQLRILSHESVCGFLTHCGSGSIVEGLMFGHPLIMLPIFG

DQPLNARLLEDKQVGIEIPRNEEDGCLTKESVARSLRSVVVEKEGEIYKANARELSKIYNDTKV

EKEYVSQFVDYLEKNTRAVAIDHES

-continued

Stevia rebaudiana UGT91D2e
(SEQ ID NO: 149)
MATSDSIVDDRKQLHVATFPWLAFGHILPYLQLSKLIAEKGHKVSFLSTTRNIQRLSSHISPLI

NVVQLTLPRVQELPEDAEATTDVHPEDIPYLKKASDGLQPEVTRFLEQHSPDWIIYDYTHYWLP

SIAASLGISRAHFSVTTPWAIAYMGPSADAMINGSDGRTTVEDLTTPPKWFPFPTKVCWRKHDL

ARLVPYKAPGISDGYRMGLVLKGSDCLLSKCYHEFGTQWLPLLETLHQVPVVPVGLLPPEIPGD

EKDETWVSIKKWLDGKOKGSVVYVALGSEVLVSQTEVVELALGLELSGLPFVWAYRKPKGPAKS

DSVELPDGFVERTRDRGLVWTSWAPQLRILSHESVCGFLTHCGSGSIVEGLMFGHPLIMLPIFG

DQPLNARLLEDKQVGIEIPRNEEDGCLTKESVARSLRSVVVEKEGEIYKANARELSKIYNDTKV

EKEYVSQFVDYLEKNARAVAIDHES

OsUGT1-2
(SEQ ID NO: 150)
MDSGYSSSYAAAAGMHVVICPWLAFGHLLPCLDLAQRLASRGHRVSFVSTPRNISRLPPVRPAL

APLVAFVALPLPRVEGLPDGAESTNDVPHDRPDMVELHRRAFDGLAAPFSEFLGTACADWVIVD

VFHHWAAAAALEHKVPCAMMLLGSAHMIASIADRRLERAETESPAAAGQGRPAAAPTFEVARMK

LIRTKGSSGMSLAERFSLTLSRSSLVVGRSCVEFEPETVPLLSTLRGKPITFLGLMPPLHEGRR

EDGEDATVRWLDAQPAKSVVYVALGSEVPLGVEKVHELALGLELAGTRFLWALRKPTGVSDADL

LPAGFEERTRGRGVVATRWVPQMSILAHAAVGAFLTHCGWNSTIEGLMFGHPLIMLPIFGDQGP

NARLIEAKNAGLQVARNDGDGSFDREGVAAAIRAVAVEEESSKVFQAKAKKLQEIVADMACHER

YIDGFIQQLRSYKD

Arabidopsis thaliana AAN72025.1
(SEQ ID NO: 151)
MGSISEMVFETCPSPNPIHVMLVSFQGQGHVNPLLRLGKLIASKGLLVTEVTTELWGKKMRQAN

KIVDGELKPVGSGSIRFEFFDEEWAEDDDRRADFSLYIAHLESVGIREVSKLVRRYEEANEPVS

CLINNPFIPWVCHVAEEFNIPCAVLWVQSCACFSAYYHYQDGSVSFPTETEPELDVKLPCVPVI

KNDEIPSFLHPSSRFTGFRQAILGQFKNLSKSFCVLIDSFDSLEREVIDYMSSLCPVKTVGPLE

KVARTVTSDVSGDICKSTDKCLEWLDSRPKSSVVYISFGTVAYLKQEQIEEIAHGVLKSGLSFL

NVIRPPPHDLKVETHVLPQELKESSAKGKGMIVDWCPQEQVLSHPSVACFVTHCGWNSTMESLS

SGVPVVCCPQWGDOVTDAVYLIDVFKTGVRLGRGATEERVVPREEVAFKTLEATVGEKAEELRK

NALKWKAEAEAAVAPGGSSDKNFREFVEKLGAGVTKTKDNGY

Arabidopsis thaliana AAF87256.1
(SEQ ID NO: 152)
MGSHVAQKQHVVCVPYPAQGHINPMMKVAKLLYAKGFHITFVNTVYNHNRLLRSRGPNAVDGLP

SFRFESIPDGLPETDVDVTQDIPTLCESTMKHCLAPFKELLRQINARDDVPPVSCIVSDGCMSF

TLDAAEELGVPEVLFWTTSACGFLAYLYYYRFIEKGLSPIKDESYLTKEHLDTKIDWIPSMKNL

RLKDIPSFIRTTNPDDIMLNFIIREADRAKRASAIILNTFDDLEHDVIQSMKSIVPPVYSIGPL

HLLEKQESGEYSEIGRTGSNLWREETECLDWLNTKARNSVVYVNFGSITVLSAKQLVEFAWGLA

ATGKEFLWVIRPDLVAGDEAMVPPEFLTATADRRMLASWCPQEKVLSHPAIGGFLTHCGWNSTL

ESLCGGVPMVCWPFFAEQQTNCKFSRDEWEVGIEIGGDVKREEVEAVVRELMDEEKGKNMREKA

EEWRRLANEATEHKHGSSKLNFEMLVNKVLLGE

Columba livia CIUGTI
(SEQ ID NO: 153)
MIHCGKKHICAFVTCILISASILMYSWKDPQLQNNITRKIFQATSALPASQLCRGKPAQNVITA

LEDNRTFIISPYFDDRESKVTRVIGIVHHEDVKQLYCWFCCQPDGKIYVARAKIDVHSDRFGFP

YGAADIVCLEPENCNPTHVSIHQSPHANIDQLPSFKIKNRKSETFSVDFTVCISAMFGNYNNVL

QFIQSVEMYKILGVQKVVIYKNNCSQLMEKVLKFYMEEGTVEIIPWPINSHLKVSTKWHFSMDA

-continued

KDIGYYGQITALNDCIYRNMQRSKFVVLNDADELILPLKHLDWKAMMSSLQEQNPGAGIFLFEN

HIFPKTVSTPVFNISSWNRVPGVNILQHVHREPDRKEVFNPKKMIIDPRQVVQTSVHSVLRAYG

NSVNVPADVALVYHCRVPLQEELPRESLIRDTALWRYNSSLITNVNKVLHQTVL

Haemophilus ducreyi LgtE Q9L875
(SEQ ID NO: 154)
MPTLTVAMIVKNEAQDLAECLKTVDGWVDEIVIVDSGSTDDTLKIATQFNAKVYVNSDWQGFGP

QRQFAQQYVTSDYVLWLDADERVTPELKASILQAVQHNQKNTVYKVSRLSEIFGKEIRYSGWYP

DYVVRLYPTYLAKYGDELVHEKVHYPADSRVEKLQGDLLHFTYKNIHHYLVKSASYAKAWAMQR

AKAGKKASLLDGVTHAIACFLKMYLFKAGFLDGKQGFLLAVLSAHSTFVKYADLWDRTRS

Neisseria gonorrhoeae Q5F735
(SEQ ID NO: 155)
MKKVSVLIVAKNEANHIRECIESCRFDKEVIVIDDHSADNTAEIAEGLGAKVFRRHLNGDFGAQ

KTFAIEQAGGEWVFLIDADERCTPELSDEISKIVRTGDYAAYPVERRNLFPNHPATHGAMRPDS

VCRLMPKKGGSVQGKVHETVQTPYPERRLKHFMYHYTYDNWEQYFNKFNKYTSISAEKYREQGK

PVSFVRDIILRPIWGFFKIYILNKGFLDGKMGWIMSVNHSYYTMIKYVKLYYLYKSGGKE

Rhizobium meliloti (strain 1021) ExoM P33695
(SEQ ID NO: 156)
MPNETLHIDIGVCTYRRPELAETLRSLAAMNVPERARLRVIVADNDAEPSARALVEGLRPEMPF

DILYVHCPHSNISIARNCCLDNSTGDFLAFLDDDETVSGDWLTRLLETARTTGAAAVLGPVRAH

YGPTAPRWMRSGDFHSTLPVWAKGEIRTGYTCNALLRRDAASLLGRRFKLSLGKSGGEDTDFFT

GMHCAGGTIAFSPEAWVHEPVPENPASLAWLAKRRFSGQTHGRLLAEKAHGLROAWNIALAGA

KSGFCATAAVLCFPSAARRNRFALRAVLHAGVISGLLGLKEIEQYGAREVTSA

Rhizobium radiobacter Q44418
(SEQ ID NO: 157)
MCRCGRAVRSRPVCRPGQLVVRRSPRPRSRNHSRCRPLRLSVFPRPHRRVRHHCQRDLRWEPGR

NIAVRWKAARSHRRFRRCPFPRQLVWPVRERHRDAGDRRNQRERRRRDAYHEISEPKFRTRKRT

ESFWMNKAITVIVWLLVSLCVLAIITMPVSLQTHLVATAISLILLATIKSFNGQGAWRLVALGF

GTAIVLRYVYWRTTSTLPPVNQLENFIPGFLLYLAEMYSVVMLGLSLVIVSMPLPSRKTRPGSP

DYRPTVDVFVPSYNEDAELLANTLAAAKNMDYPADRFTVWLLDDGGSVQKRNAANIVEAQAAQR

RHEELKKLCEDLDVRYLTRERNVHAKAGNLNNGLAHSTGELVTVFDADHAPARDFLLETVGYFD

EDPRLFLVQTPHFFVNPDPIERNLRTFETMPSENEMFYGIIQRGLDKWNGAFFCGSAAVLRREA

LQDSDGFSGVSITEDCETALALHSRGWNSVYVDKPLIAGLQPATFASFIGQRSRWAQGMMQILI

FRQPLFKRGLSFTQRLCYMSSTLFWLFPFPRTIFLEAPLFYLFFDLQIFVASGGEFLAYTAAYM

LVNLMMQNYLYGSFRWPWISELYEYVQTVHLLPAVVSVIFNPGKPTFKVTAKDESIAEARLSEI

SRPFFVIFALLLVAMAFAVWRIYSEPYKADVTLVVGGWNLLNLIFAGCALGVVSERGDKSASRR

ITVKRRCEVQLGGSDTWVPASIDNVSVHGLLINIFDSATNIEKGATAIVKVKPHSEGVPETMPL

NVVRTVRGEGFVSIGCTFSPQRAVDHRLIADLIFANSEQWSEFQRVRRKKPGLIRGTAIFLAIA

LFQTQRGLYYLVRARRPAPKSAKPVGAVK

Streptococcus agalactiae cpsI O87183
(SEQ ID NO: 158)
MIKKIEKDLISVIVPIYNVEDYLVECIESLIVQTYRNIEILLINDGSTDNCATIAKEFSERDCR

VIYIEKSNGGLSEARNYGIYHSKGKYLTFVDSDDKVSSDYIANLYNAIQKHDSSIAIGGYLEFY

ERHNSIRNYEYLDKVIFVEEALLNMYDIKTYGSIFITAWGKLFHKSIFNDLEFALNKYHEDEFF

NYKAYLKANSITYIDKPLYHYRIRVGSIMNNSDNVIIARKKLDVLSALDERIKLITSLRKYSVF

LQKTEIFYVNQYFRTKKFLKQQSVMFKEDNYIBAYRMYGRLLRKVKLVDKLKLIKNRFF

-continued

*Streptococcus pneumoniae* cps33 054611

(SEQ ID NO: 159)
MYTFILMLLDFFQNHDFHFFMLFFVFILIRWAVIYFHAVRYKSYSCSVSDEKLFSSVIIPVVDE
PLNLFESVLNRISRHKPSEIIVVINGPKNSRLVKLCHDFNEKLENNMTPIQCYYTPVPGKRNAI
RVGLEHVDSQSDITVLVDSDTVWTPRTLS3LLKPFVCDKKIGGVTTRQKILDPERNLVTMFANL
LEEIRAEGTMKAMSVTGKVGCLPGRTIAFRNIVERVYTKFIEETFMGFHKEVSDDRSLTNLTLK
KGYKTVMQDTSVVYTDAPTSWKKFIRQQLRWAEGSQYNNLKMTPWMIRNAPLMFFIYFTDMILP
MLLISFGVNIFLLKILNITTIVYTASWWEEILYVLLGMIFSFGGRNFKAMSRMKWYYVFLIPVF
IIVLSIIMCPIRLLGLMRCSDDLGWGTRNLTE

MbUGTc13

(SEQ ID NO: 160)
MADAMATTEKKPHVIFIPFPAQSHIKAMLKLAQLLHHKGLQITFVNTDFIHNQFLESSGPHCLD
GAPGFRFETIPDGVSHSPEASIPIRESLLRSIETNFLDRFIDLVTKLPDPPTCIISDGFLSVFT
IDAAKKLGIPVMMYWTLAACGFMGFYHIHSLIEKGFAPLKDASYLTNGYLDTVIDWVPGMEGIR
LKDFPLDWSTDLNDKVLMFTTEATQRSHKVSHKIFHTFDELEPSIIKTLSLRYNHIYTIGPLQL
LLDQIPEEKKQTGITSLHGYSLVKEEPECFQWLQSKEPNSVVYVNFGSTTVMSLEDMTEFGWGL
ANSNHYFLWIIRSNLVIGENAVLPPELEEHIKKRGFIASWCSQEKVLKHFSVGGFLTHCGWGST
IESLSAGVPMICWPYSWDQLTNCRYICKEWEVGLEMGTKVKRDEVKRLVQELMGEGGHKMRNKA
KDWKEKARIAIAPNGSSSLNIDKMVKEITVLARN

MbUGTc19

(SEQ ID NO: 161)
MANHHECMNWLDDKPKESVVYVAFGSLVKIGPEQVEEITRALIDSDVNFLWVIKHKEEGKLPEN
LSEVIKTGKGLIVAWCKQLDVLAHESVGQFVTHCGENSTLEASLGVPVVAMPQFSDQTTNAKL
LDEILGVGVRVKADENGIVRRGNLASCIKMIMEEERGVIIRKNAVKWKDLAKVAVHEGGSSDND
IVEFVSELIKAGSGEQQKIKKSPHVLLIPFPLQGHINPFIQFGKRLISKGVKTTLVTTIHTLNS
TLNHSNTTTTSIEIQAISDGCDEGGFMSAGESYLETFKQVGSKSLADLIKKLQSEGTTIDAIIY
DSMTEWVLDVAIEFGIDGGSFFTQACWNSLYYHVHKGLISLPLGETVSVPGFPVLQRWETPLI
LQNHEQIQSPWSQMLFGQFANIDQARWVFTNSFYKLEEEVIEWTRKIWNLKVIGPTLPSMYLDK
RLDDDKDNGFNLYKA

MbUGT1-3

(SEQ ID NO: 162)
MENKTETTVRRRRRIILFPVPFQGHINPILQLANVLYSKGFSITIFHTNFNKPKTSNYPHFTFR
FILDNDPQDERISNLPTHGPLAGMRIPIINEHGADELRRELELLMLASEEDEEVSCLITDALWY
FAQSVADSLNLRRLVLMTSSLFNFHAHVSLPQFDELGYLDPDDKTRLEEQASGFPMLKVKDIKS
AYSNWQILKEILGKMIKQTKASSGVIWNSFKELEESELETVIREIPAPSFLIPLPKHLTASSSS
LLDHDRTVFQWLDQQPPSSVLYVSFGSTSEVDEKDFLEIARGLVDSKQSFLWVVRPGFVKGSTW
VEPLPDGFLGERGRIVKWVPQQEVLAHGAIGAFWTHSGWNSTLESVCEGVPMIFSDFGLDQPLN
ARYMSDVLKVGVYLENGWERGEIANAIRRVMDEEGEYIRQNARVLKQKADVSLMKGGSSYESL
ESIVSYISSI

MbUGT1-2

(SEQ ID NO: 163)
MATKGSSGMSLAERFWLTLSRSSLVVGRSCVEFEPETVPLLSTLRGKPITFLGLMPPLHEGRRE
DGEDATVRWLDAQPAKSVVYVALGSEVPLGVEKVHELALGLELAGTRFLNALRKPTGVSDADLL
PAGFEERTRGRGVVATRWVPQMSILAHAAVGAFLTHCGWNSTIEGLMFGHPLIMLPIFGDQGPN
ARLIEAKNAGLQVARNDGDGSFDREGVAAAIRAVAVEEESSKVFQAKAKKLQEIVADMACHERY
IDGFIQQLRSYKDDSGYSSSYAAAAGMHVVICPWLAFGHLLPCLDLAQRLASRGHRVSFVSTPR

-continued

NISRLPPVRPALAPLVAFVALPLPRVEGLPDGAESTNDVPHDRPDMVELHRRAFDGLAAPFSEE

LGTACADWVIVDVFHHWAAAAALEHKVPCAMMLLGSAEMIASIADERLEHAETESPAAAGQGRP

AAAPTFEVARMKLIR

Coffea arabica (CaUGT_1, 6)
(SEQ ID NO: 164)
MAENHATFNVLMLPWLAHGHVSPYLELAKKLTARNFNVYLCSSPATLSSVRSKLTEKFSQSIHL

VELHLPKLPELPAEYHTTNGLPPHLMPTLKDAFDMAKPNFCNVLKSLKPDLLIYDLLQPWAPEA

ASAFNIPAVVFISSSATMTSFGLHFFKNPGTKYPYGNAIFYRDYESVFVENLTRRDRDTYRVIN

CMERSSKIILIKGFNEIEGKYFDYFSCLTGKKVVPVGPLVQDPVLDDEDCRIMQWLNKKEKGST

VFVSFGSEYFLSKKDMEEIAHGLEVSNVDFIWVVRFPKGENIVIEETLPKGFFERVGERGLVVN

GWAPQAKILTHPNVGGFVSHCGWNSVMESMKFGLPIIAMPMHLDQPINARLIEEVGAGVEVLRD

SKGKLHRERMAETINKVMKEASGESVRKKARELQEKLELKGDEEIDDVVKELVQLCATKNKRNG

LHYY

Stevia rebaudiana UGT85C1
(SEQ ID NO: 165)
MADQMAKIDEKKPHVVFIPFPAQSHIKCMLKLARILHQKGLYITFINTDTNHERLVASGGTQWL

ENAPGFWFKTVPDGFGSAKDDGVKPTDALRELMDYLKTNFFDLFLDLVLKLEVPATCIICDGCM

TFANTIRAAEKLNIPVILFWTMAACGFMAFYQAKVLKEKEIVPVKDETYLTNGYLDMEIDWIPG

MKRIRLRDLPEFILATKQNYFAFEFLFETAQLADKVSHMIIHTFEELEASLVSEIKSIFPNVYT

IGPLQLLLNKITQKETNNDSYSLWKEEPECVEWLNSKEPNSVVYVNFGSLAVMSLQDLVEFGWC

LVNSNHYFLWIIRANLIDGKPAVMPQELKEAMNEKGFVGSWCSQEEVLNHPAVGGFLTHCGWGS

IIESLSAGVPMLGWPSIGDQRANCRQMCKEWEVGMEIGKNVKRDEVEKLVRMLMEGLEGERMRK

KALEWKKSATLATCCNGSSSLDVEKLANEIKKLSRN

Arabidopsis thaliana AtUCT7303
(SEQ ID NO: 202)
MATEKTHQFHPSLHFVLFPFMAQGHMIPMIDIARLLAQRGVTITIVTTPHNAARFKNVLNRAIE

SGLAINILHVKFPYQEFGLPEGKENIDSLDSTELMVPFFKAVNLLEDPVMKLMEEMKPRPSCLI

SDVVCLPYTSIIAKNFNPKIVFHGMGCFNLLCMHVLRRNLEILENVKSDEEYFLVPSFPDRVEE

TKLQLPVKANASGDWKEIMDEMVKAEYTSYGVIVNTFQELEPPYVKDYKEAMDGKVWSIGPVSL

CNKAGADKAERGSKAAIDQDECLQWLDSKEEGSVLYVCLGSICNLPLSQLKELGLGLEESRRSF

IWVIRGSEKYKELFEWMLESGFEERIKERGLLIKGWAPQVLILSHPSVGGFLTHCGWNSTLEGI

TSGIPLITWPIFGDQFCNQKLVVQVLKAGVSAGVEEVMKWGEEDKIGVLVDKEGVKKAVEELMG

DSDDAKERRRRVKELGELAHKAVEKGGSSHSNITLLLQDIMQLAQFKN

Hordeum vulgare subsp. Vulgare HVUGT_B1
(SEQ ID NO: 204)
MAQAESERMRVVMFPWLAHGHINPYLELAKRLIASASGDHHLDVVVHLVSTPANLAPLAHHQTD

RLRLVELHLPSLPDLPPALHTTKGLPARLMPVLKRACDLAAPRFGALLDELCPDILVYDFIQPW

APLEAEARGVPAFHFATCGAAATAFFIHCLKTDRPPSAFPFESISLGGVDEDAKYTALVTVRED

STALVAERDRLPLSLERSSGFVAVKSSADIERKYMEYLSQLLGKEIIPTGPLLVDSGGSEEQRD

GGRIMRWLDGEEPGSVVFVSFGSEYFMSEHQMAQMARGLELSGVPFLWVVRFPNAEDDARGAAR

SMPPGFEPELGLVVEGWAPQRRILSHPSCGAFLTHCGWSSVLESMAAGVPMVALPLHIDQPLNA

-continued

NLAVELGAAAARVKQERFGEPTAEEVARAVRAAVKGKEGEAARRRARELQEVVARNNGNDGQIA

TLLQRMARLCGKDQAVPN

*Hordeum vulgare* subsp. *Vulgare* HVUGT_B3

(SEQ ID NO: 205)

MAEANDGGKMHVVMLPWLAFGHVLPFTEFAKRVARQGHRVTLLSAPRNTRRLIDIPPGLAGLIR

VVHvPLPRVDGLPEHAEATIDLPSDHLRPCLRRAFDAAFERELSRLLQEEAKPDWVLVDYASYW

APTAAARHGVPCAFLSLFGAAALSFFGTPETLLGIGRHAKTEPAHLTVVPEYVPFPTTVAYRGY

EARELFEPGMVPDDSGVSEGYRFAKTIEGCQLVGIRSSSEFEPEWLRLLGELYRKPVIPVGLFP

PAPQDDvAGHEATLRWLDGQAPSSVVYAAFGSEVKLTGAOLQRIALGLEASGLPFIWAFRAPTS

TETGAASGGLPEGFEERLAGRGVVCRGVVPQVKFLAHASVGGFLTHAGWNSIAEGLAHGVRLVL

LPLVFEQGLNARNIVDKNIGVEVARDEQDGSFAAGDIAAALRRVMVEDEGEGFGAKVKELAKVF

GDDEVNDQCVREFLMHLSDHSKKNQGQD

MbUGT1,2.2

(SEQ ID NO: 206)

MATKGSSGMSLAERFWLTLSRSSLVVGRSCVEFEPETVPLLSTLRGKPITFLGLMPPLHEGRRE

DGEDATVRWLDAQPAKSVVYVALGSEVPLGVEKVHELALGLELAGTRFLWALRKPTGVSDADLL

PAGFEERTRGRGVVATRWVPQMSILAHAAVGAFLTHCGWNSTIEGLMFGHPLIMLPIFGDQGPN

ARLIEAKNAGLQVARNDGDGSFDREGVAAAIRAVAVEEESSKvFQAKAKKLQEIVADMACHERY

IDGFIQQLRSYKDDSGYSSSYAAAAGMHVVICPWLAFGHLLPCLDLAQRLASRGHRVSFVSTPR

NISRLPPVRPALAPLVAFVALPLPRVEGLPDGAESTNDVPHDRPDMVELHRRAFDGLAAPFSEF

LGTACADWVIVDVFHHWAAAAALEHKVPCAMMLLGSAEMIASIADERLEHAETESPAAAGQGRP

AAAPTFEVARMKLIR

*Coffea canephora* (CCUGT_1,6) (207)

MAENHATFNVLMLPWLARGHVSPYLELAMKLTARNFNVYLCSSPATLSSVRSKLTEKFSQSIHL

VELHLPKLPELPAEYHTTNGLPPHLMPTLKDAFDMAKPNFCNVLKSLKPDLLIYDLLQPWAPEA

ASAFNTPAVVFISSSATMTSFGLHFFKNPGTKYPYGNTIFYRDYESVFVENLKKRDRDTYRVVN

CMERSSKIILIKGFKEIEGKYFDYFSCLTGKKVVPVGPLVQDPVLDDEDCRIMQWLNKKEKGST

VFVSFGSEYFLSKEDMEEIAHGLELSNVDFIWVVRFPKGENIVIEETLPKGFFERVGERGLVVN

GWAPQAKILTHPNVGGFVSHCGWNSVMESMKFGLPIVAMPMHLDQPINARLIEEVCAGVEVLRD

SKGKLHRERMAETINKVTKEASGEPARKKARELQEKLELKGDEEIDDWKELVQLCATKNKRNG

LHCYN

*Coffea eugenioides* (CeUGT_1,6) (208)

MAENHATFNVLMLPWLAHGHVSPYLELAKKLTARNFNVYLCSSPATLSSVRSKLTEKFSQSIHL

VELHLPKLPELPAEYHTTNGLPPHLMPTLKDAFDMAEPNFCNVLKSLKPDLLIYDLLQPWAPEA

ASAFNIPAVVFISSSATMTSFGLHFFKNPGTKYPYGNTIFYRDYESVFVENLKRRDRDTYRVVN

CMERSSKIILIKGFKEIEGKYFDYFSCLTGKKVVPVGPLVQDPVLDDEDCRIMQWLNKKEKGST

VEVSFGSEYFLSKEDMEEIAHGLELSNVDFIWVVREPKGENIVIEETLPKGEFERVGERGLVVN

GWAPQAKILTHPNVGGFVSHCGWNSVMESMKFGLPIIAMPMHLDQPINARLIEEVGAGVEVLRD

SKGKLHRERMAETINKVTKEASGESVRKKARELQEKLELKGDEEIDDVVKELVQLCATKNKRNG

LHYN

*Coffea eugenioides* (CeUGT 1,6.2) (209)

MAENHATFNVLMLPWLAHGHVSPYLELAKKLTARNFNVYLCSSPATLSSVRSKLTEKFSQSIHL

VELHLPKLPELPABYHTTNGLPPHLMPTLKDAFDMAKPNFCNVLKSLKPDLLIYDLLQPWAPEA

ASAFNIPAVVFISSSATMTSFGLHFFKNPGTKYPYGNAIFYRDYESVFVENLTRRDRDTYRVIN

-continued

CMERSSKIILIKGFNEIEGKYFDYFSCLTGKKVVPVGPLVQDPVLDDEDCEIMQWLNKKEKVST

VFVSFGSEYFLSKKDMEEIAHGLELSNVDFIWVVRFPKGENIVIEETLPKGFFERVGERGLVVN

GWAPQAKILTEPNVGGFVSHCGWNSVMESMKFGLPIIAMPMHLDQPINARLIEEVGAGVEVLRD

SKGKLHRERMAETINKVMKEASGESVRKKARELQEKMDLKGDEEIDDVVKELVQLCATKNKRNG

LHYY

*Siraitia grosvenorii* (SgUGT94-289-3.2) (210)
MADAAQQGDTTTILMLPWLGYGHLSAFLELAKSLSRRNFHIYFCSTSVNLDAIKPKLPSSFSDS

IQFVELHLPSSPEFPPHLHTTNGLPPTLMPALHQAFSMAAQHFESILQTLAPHLLIYDSLQPWA

PRVASSLKIPAINFNTTGVFVISQGLHPIHYPHSKFPFSEFVLHNHWKAMYSTADGASTERTRK

RGEAFLYCLHASCSVILINSFRELEGKYMDYLSVLLNKKVVPVGPLVYEPNQDGEDEGYSSIKN

NLDKKEPSSTVFVSFGSEYFPSKEEMEEIAHGLEASEVNFIWVVRFPQGDNTSGIEDALPKGFL

ERAGERGMVVKGWAPQAKILKHWSTGGFVSHCGWNSVMESMMFGVPIIGVPMHVDQPFNAGLVE

EAGVGVEAKRDPDGKIQRDEVAKLIKEVVVEKTREDVRKKAREMSEILRSKGEEKFDEMVAEIS

LLLKI

*Oryza sativa* (OsJUGT 1, 6)
(SEQ ID NO: 211)
MAQAERERLRVLMFPWLAHGHINPYLELATRLTTTSSSQIDVVVHLVSTPVNLAAVAHRRTDRI

SLVELHLPELPGLPPALHTTKHLPPRLMPALKRACDLAAPAFGALLDELSPDVVLYDFIQPWAP

LEAAARGVPAVHFSTCSAAATAFFLHFLDGGGGGGGRGAFPFEAISLGGAEEDARYTMLTCRDD

CTALLPKGERLPLSFARSSEFVAVKTCVEIESKYMDYLSKLVGKEIIPCGPLLVDSGDVSAGSE

ADGVMRWLDGQEPGSVVLVSFGSEYFMTEKQLAEMARGLELSGAAFVWVVRFPQQSPDGDEDDH

GAAAARAMPPGFAPARGLVVEGWAPQRRVLSHRSCGAFLTHCGWSSVMESMSAGVPMVALPHI

DQPVGANLAAELGVAARVRQERFGEFEAEEVARAVRAVMRGGEALRRRATELREVVARRDAECD

EQIGALLHRMARLCGKGTGRAAQLGH

*Panax ginseng* (PsUGT94_B1)
(SEQ ID NO: 213)
MADNQNGRISIALLPFLAHGHISPFFELAKQLAKRNCNVFLCSTPINLSSIKDKDSSASIKLVE

LHLPSSPDLPPHYHTTNGLPSHLMLPLRNAFETAGPTFSEILKTLNPDLLIYDFNPSWAPEIAS

SHNIPAVYFLTTAAASSSIGLHAFKNPGEKYPFPDFYDNSNITPEPPSADNMKLLHDFIACFER

SCDIILIKSFRELEGKYIDLLSTLSDKTLVPVGPLVQDPMGHNEDPKTEQIINWLDKRAESTVV

FVCFGSEYFLSNEELEEVAIGLEISTVNFIWAVRLIEGEKKGILPEGFVQRVGDRGLVVEGWAP

QARILGHSSTGGFVSHCGWSSIAESMKFGVPVIAMARHLDQPLNGKLAAEVGVGMEVVRDENGK

YKREGIAEVIRKVVVEKSGEVIRRKARELSEKMKEKGEQEIDRALEELVQICKKKKDEQ

*Stevia rebaudiana* (SrUGT73E1, with optional His tag)
(SEQ ID NO: 214)
MAHHHHHHVGTGSNDDDDKSPDPNWASTSELVFIPSPGAGHLPPTVELAKLLLHRDQRLSVTII

VMNLWLGPKHNTEARPCVPSLRFVDIPCDESTMALISPNTFISAFVEHHKPRVRDIVRGIIESD

SVRLAGEVLDMECMPMSDVANEFGVPSYNYETSGAATLGLMEHLQWKRDHEGYDATELKNSDTE

LSVPSYVNPVPAKVLPEVVLDKEGGSKMFLDLAERIRESKGIIVNSCQAIERHALEYLSSNNNG

IPPVFPVGPILNLENKKDDAKTDEIMRWLNEQPESSVVFLCFGSMGSFNEKQVKEIAVAIERSG

HRFLWSLRRPTPKEKIEFPKEYENLEEVLPECFLKRTSSIGKVIGWAPQMAVLSHPSVGGFVSH

-continued

CGWNSTLESMWCGVPMAAWPLYAEQTLNAFLLVVELGLAAEIRMDYRTDTKAGYDGGMEVTVEE

IEDGIRKLMSDGEIRNKVKDVKEKSRAAVVEGGSSYASIGKFIEHVSNVTI

Oryza sativa (OsUGT1-2)
(SEQ ID NO: 215)
MADSGYSSSYAAAAGMHVVICPWLAFGHLLPCLDLAQRLASRGHRVSFVSTPRNISRLPPVRPA

LAPLVAFVALPLPRVEGLPDGAESTNDVPHDRPDMVELHRRAFDGLAAPFSEFLGTACADWVIV

DVFHHWAAAAALEHKVPCAMMLLGSAHMIASIADRRLERAETESPAAAGQGRPAAAPTFEVARM

KLIRTKGSSGMSLAERFSLTLSRSSLVVGRSCVEFEPETVPLLSTLRGKPITFLGLMPPLHEGR

REDGEDATVRWLDAQPAKSVVYVALGSEVPLGVEKVHELALGLELAGTRFLWALRKPTGVSDAD

LLPAGFEERTRGRGVVATRWVPQMSILAHAAVGAFLTHCGWNSTTEGLMFGHPLIMLPIFGDQG

PNARLIEAKNAGLQVARNDGDGSFDREGVAAAIRAVAVEEESSKVFQAKAKKLQEIVADMACHE

RYIDGFIQQLRSYKD

Camelina sativa (XP_010516905.1)
(SEQ ID NO: 216)
MASEKTLQVHPPLHFVLFPFMAQGHMIPMVDIARLLAQRGATVTIVTTRYNAGRFENVLSRAVE

SGLPINIVHVKFPYEEVGLPKGKENIDSLDSMELMVPFFKAVNMLQDPVVKLMEEMESRPSCII

SDLLLPYTSKIAKKFNIPKIVFHGISCFCLLCVHVLRRNLEILTNLKSDKEYFLVPSFPDRVEF

TKPQVTVETNASGDWKEFLDEMVEAEDTSYGVIINTFEELEPAYVKDYKDARAGNVWSIGPVSL

CNKAGVDKAERGNKATIDQDECLKWLDSKEEGSVLYVCLGSICNLPLVQLKELGLGLEESQRPF

IWVIRGWEKYNELSEWMVESGFEERIRERGLLIRGWAPQVLILSHPSVGGFLTHCGWNSTVEGI

TSGVPLITWPLFGDQFCNQTLVVQVLKAGVSVGVEEVMKWGEEEKIGVLVDKEGVKKAVEDLMG

ESDDAKERTKRVKELGGLAHKAVEEGGSSHSNITLFLQDIRQVOSV

Glycyrrhiza uralensis (UGT73F24)
(SEQ ID NO: 217)
MADVAEEQPLKIYFIPYLAAGHMIPLCDIATLFASRGHHVTIITTPSNAQTLRESHHFRVQTIQ

FPSQEVGLPAGVQNLTAVTNLDDSYKIYHATMLLRKHIEDFVERDPPDCIVADFLFPWVDDVAT

KLHIPRLVFNGFTLFTICAMESHKAHPLPVDAASGSFVIPDFPHHVTINSTPPKRTKEFVDPLL

TEAFKSHGFLINSFVELDGEECVEHYERITGGHKAWHLGPAFLVHRTAQDRGEKSVVSTQECLS

NLDSKRDNSVLYICFGTICYFPDKQLYEIASAIEASGHEFIWVVPEKRGNADESEEEKEKWLPK

GFEERNNGKKGMIIRGWAPQVAILGHPAVGGFLTHCGWNSTVEAVSAGVPMITWPVHSDQYFNE

KLITQVRGIGVEVGAEEWIVTAFRETEKLVGRDRIERAVRRVMDGGDEAVQIRRRARELGEMAR

QAVQEGGSSHTNLTALINDLKRWRDSKQLN

Glycyrrhiza uralensis (UGT73O33)
(SEQ ID NO: 218)
MAVFQANQPHFVLFPLMAQGHIIPMIDIARLLAQRGAIVTIFTTPKNASRFTSVLSRAVSSGLQ

IRLVHLHFPSKEAGLPEGCENLDMVASHDMICNIFQAIRMLQKQAEELFETLTPKPSCIISDFC

IPWTTQVAEKEHIPRISFHGFSCFCLHCMLKIHTSKVLEGITSESEYETVPGIPDQIQVTKQQV

PGPMIDEMKEFGEQMRDAEIRSYGVIINTFEELEKAYVNDYKKERNGKVWCIGPVSLCNKDGLD

KAQRGNKASISEHHCLEWLDLQQPNSVIYVCLGSLCNLTPPQLMELALGLEATKRPFTWVIREG

NKFEELEKWISEEGFEERIKGRGLIIRGWAPQVLILSHPSIGGFLTHCGWNSTLEGVTAGVPMV

TWPLFADQFLNEKLVTQVLRIGVSLGVDVPLKWGEEEKVGVQVKKEGIEKAICMVMDEGEESKE

RRERAKELSEMAKRAVEKDGSSHLNMTMLIQDIMQQSSSKVET

SEQUENCE LISTING (223 sequences)

SEQ ID NO: 1 - protein, 352 aa, Saccharomyces cerevisiae
MASEKEIRRERFLNVFPKLVEELNASLLAYGMPKEACDWYAHSLNYNTPGGKLNRGLSVVDTYAILSNKTVEQLGQEEYEKVAILGWCIELLQAYFLVADDMMDKSITRRGQPCWYKVPEVGEIAINDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 2 - protein, 417 aa, Siraitia grosvenorii
MGSLGAILRHPDDFYPLLKLKMAARHAEKQIPPEPHWGFCYTMLHKVSRSFALVIQQLAPELRNAICIFYLVLRALDTVEDDTSIQTDIKVPILKAFHCHIYNRDWHFSCGTKDYKVLMDQFHHVSTAFLELGKGYQEAIEDITKRMGAGMAKFICKEVETVDDYDEYCHYVAGLVGLGLSKLFHASDLEDLAPDSLSNSMGLLLQKTNIIRDYLEDINEIPKSRMFWPREIWGKYADKLEDFKYEENSVKAVQCLNDLVTNALNHVEDCLKYMSNLRDLSIFRFCAIPQIMAIGTLALCYNNVEVFRGVVKMRRGLTAKVIDRTQTMADVYGAFFDFSVMLKAKVNSSDPNATKTLSRIEAIQKTCEQSGLLNKRKLYAVKSEPMFNPTLIVILFSLLCIILAYLSAKRLPANQPV

SEQ ID NO: 3 - protein, 417 aa, Siraitia grosvenorii
MGSLGAILRHPDDFYPLLKLKMAARHAEKQIPPEPHWGFCYTMLHKVSRSFALVIQQLAPELRNAICIFYLVLRALDTVEDDTSIQTDIKVPILKAFHCHIYNRDWHFSCGTKDYKVLMDQFHHVSTAFLELGKGYQEAIEDITKRMGAGMAKFICKEVETVDDYDEYCHYVAGLVGLGLSKLFHASDLEDLAPDSLSNSMGLLLQKTNIIRDYLEDINEIPKSRMFWPREIWGKYADKLEDFKYEENSVKAVQCLNDLVTNALNHVEDCLKYMSNLRDLSIFRFCAIPQIMAIGTLALCYNNVEVFRGVVKMRRGLTAKVIDRTQTMADVYGAFFDFSVMLKAKVNNSDPNATKTLSRIEAIQKTCEQSGLLNKRKLYAVKSEPMFNPTLIVILFSLLCIILAYLSAKRLPANQPV

SEQ ID NO: 4 - protein, 417 aa, Cucumis sativus
MGSLGAILKHPDDFYPLLKLKIAARHAEKQIPPEPHWGFCYTMLHKVSRSFALVIQQLKPELRNAVCIFYLVLRALDTVEDDTSIQTDIKVPILKAFHCHIYNRDWHFSCGTKDYKVLMDEFHHVSTAFLELGKGYQEAIEDITKRMGAGMAKFICKEVETVDDYDEYCHYVAGLVGLGLSKLFHAAELEDLAPDSLSNSMGLFLQKTNIIRDYLEDINEIPKSRMFWPREIWGKYADKLEDFKYEENSVKAVQCLNDLVTNALNHVEDCLKYMSNLRDLSIFRFCAIPQIMAIGTLALCYNNVEVFRGVVKMRRGLTAKVIDRTKTMADVYGAFFDFSVMLKAKVNSNDPNASKTLSRIEAIQKTCKQSGILNRRKLYVVRSEPMFNPAVIVILFSLLCIILAYLSAKRLPANQSV

SEQ ID NO: 5 - protein, 417 aa, Cucumis melo
MGSLGAILKHPDDFYPLLKLKMAARHAEKQIPPESHWGFCYTMLHKVSRSFALVIQQLKPELRNAVCIFYLVLRALDTVEDDTSIQTDIKVPILKAFHCHIYNRDWHFSCGTKDYKVLMDEFHHVSTAFLELGKGYQEAIEDITKRMGAGMAKFICKEVETVDDYDEYCHYVAGLVGLGLSKLFHAAELEDLAPDSLSNSMGLFLQKTNIIRDYLEDINEIPKSRMFWPREIWGKYADKLEDFKYEENSVKAVQCLNDLVTNALNHVEDCLKYMSNLRDLSIFRFCAIPQIMAIGTLALCYNNVEVFRGVVKMRRGLTAKVIDRTKTMADVYGAFFDFSVMLKAKVNSNDPNASKTLSRIEAIQQTCQQSGLMNKRKLYVVRSEPMYNPAVIVILFSLLCIILAYLSAKRLPANQSV

SEQ ID NO: 6 - protein, 417 aa, Cucumis melo
MGSLGAILKHPDDFYPLLKLKMAARHAEKQIPPESHWGFCYTMLHKVSRSFALVIQQLKPELRNAVCIFYLVLRALDTVEDDTSIQTDIKVPILKAFHCHIYNRDWHFSCGTKDYKVLMDEFHHVSTAFLELGKGYQEAIEDITKRMGAGMAKFICKEVETVDDYDEYCHYVAGLVGLGLSKLFHAAELEDLAPDSLSNSMGLFLQKTNIIRDYLEDINEIPKSRMFWPREIWGKYADKLEDFKYEENSVKAVQCLNDLVTNALNHVEDCPKYMSNLRDLSIFRFCAIPQIMAIGTLALCYNNVEVFRGVVKMRRGLTAKVIDRTKTMADVYGAFFDFSVMLKAKVNSNDPNASKTLSRIEAIQQTCQQSGLMNKRKLYVVRSEPMYNPAVIVILFSLLCIILAYLSAKRLPANQSV

SEQ ID NO: 7 - protein, 417 aa, Cucurbita moschata
MGSLGAILRHPDDIYPLLKLKMAARHAEKQIPPESHWGFCYTMLHKVSRSFALVIQQLKPELRNAVCIFYLVLRALDTVEDDTSIQTDIKVPILKAFHCHIYNRDWHFSCGTKDYKVLMDEFHHVSTAFLELGRGYQEAIEDITKRMGAGMAKFICKEVETVEDYDEYCHYVAGLVGLGLSKLFHASKSENLAPDSLSNSMGLFLQKTNIIRDYLEDINEIPKSRMFWPREIWSKYADKLEDFKYEKNSVKAVQCLNDLVTNALTHVEDCLEYMSNLKDLSIFRFCAIPQIMAIGTLALCYNNVDVFRGVVKMRRGLTAKVIYRTKTMADVYGAFFDFSVMLKAKVNSSDPNASKTLTRIEAIQKTCKQSGLLNKRELYAVRSEPMCNPAAIVVLFSLLCIILAYLSAKLLPANQPV

SEQ ID NO: 8 - protein, 417 aa, Sechium edule
MGSLGAILSHPDDLYPLLKLKMAAKHAEKQIPPDPHWGFCFSMLHKVSRSFALVIQQLKPELRNAVCIFYLVLRALDTVEDDTGIHPDIKVPILQAFHCHIYNRDWHFSCGTKHYKVLMDEFHHVSTAFLELGKGYQEAIEDVTERMGAGMAKFICKEVETVDDYDEYCHYVAGLVGLGLSKLFHAAELEDLAPDSLSNSMGLFLQKTNIIRDYLEDINEIPKSRMFWPREIWNKYADKLEDFKYEENSVKAVQCLNDLVTNALNHVEDCLKYMSNLKDLSTFRFCAIPQIMAIGTLALCYDNVEVFRGVVKMRRGLTAKIIDRTKKIADVYGAFFDFSVMLKAKVNSSDPNAAKTLSRIEAIEKTCKESGLLNKRKLYVIRSEPLFNPAVLVILFSLICILLAYLSAKRLPANQPV

SEQ ID NO: 9 - protein, 415 aa, Panax quinquefolius
MGSLGAILKHPDDFYPLLKLKFAARHAEKQIPPEPHWAFCYSMLHKVSRSFGLVIQQLGPQLRDAVCIFYLVLRALDTVEDDTSIPTEVKVPILMAFHRHIYDKDWHFSCGTKEYKVLMDEFHHVSNAFLELGSGYQEAIEDITMRMGAGMAKFICKEVETIDDYDEYCHYVAGLVGLGLSKLFHASGAEDLATDSLSNSMGLFLQKTNIIRDYLEDINEIPKSRMFWPRQIWSKYVDKLEDLKYEENSAKAVQCLNDMVTDALVHAEDCLKYMSDLRDPAIFRFCAIPQIMAIGTLALCFNNTQVFRGVVKMRRGLTAKVIDRTKTMSDVYGAFFDFSCLLKSKVDNNDPNATKTLSRLEAIQKTCKESGTLSKRKSYIIESESGHNSALIAIIFIILAILYAYLSSNLLLNKQ

SEQ ID NO: 10 - protein, 412 aa, Malus domestica
MGALSTMLKHPDDIYPLLKLKIASRQIEKQIPAEPHWAFCYTMLQKVSRSFALVIQQLGTELRNAVCLFYLVLRALDTVEDDTSVATDVKVPILLAFHRHIYDPDWHFACGTNNYKVLMDEFHHVSTAFLELGTGYQEAIEDITKRMGAGMAKFILKEVETIDDYDEYCHYVAGLVGLGLSKLFHAAGKEDLASDSLSNSMGLFLQKTNIIRDYLEDINEIPKSRMFWPRQIWSKYVNKLEDLKYEENSEKAVQCLNDMVTNALIHMEDCLKYMAALRDPAIFKFCAIPQIMAIGTLALCYNNIEVFRGVVKMRRGLTAKVIDRTKSMDDVYGAFFDFSSILKSKVDKNDPNATKTLSRVEAVQKLCRDSGALSKRKSYIANREQSYNSTLIVALFIILAIIYAYLSASPRI

SEQ ID NO: 11 - protein, 418 aa, Artemisia annua
MSSLKAVLKHPDDFYPLLKLKMAAKKAEKQIPSQPHWAFSYSMLHKVSRSFALVIQQLNPQLRDAVCIFYLVLRALDTVEDDTSIAADIKVPILIAFHKHIYNRDWHFACGTKEYKVLMDQFHHVSTAFLELKRGYQEAIEDITMRMGAGMAKFICKEVETVDDYDEYCHYVAGLVGIGLSKLFHSSGTEILFSDSISNSMGLFLQKTNIIRDYLEDINEIPKSRMFWPREIWSKYVNKLEDLKYEENSEKAVQCLNDMVTNALIHIEDCLKYMSQLKDPAIFRFCAIPQIMAIGTLALCYNNIEVFRGVVKLRRGLTAKVIDRTKTMADVYQAFSDFSDMLKSKVDMHDPNAQTTITRLEAAQKICKDSGTLSNRKSYIVKRESSYSAALLALLFTILAILYAYLSANRPNKIKFTL

SEQ ID NO: 12 - protein, 408 aa, Glycine soja
MDQRSEDEFYPLLKLKIVARNAEKQIPPEPHWAFCYTMLHKVSRSFALVIQQLGIELRNAVCIFYLVLRALDTVEDDTSIETDVKVPILIAFHRHIYDRDWHFSCGTKEYKVLMGQFHHVSTAFLELGKNYQEAIEDITKRMGAGMAKFICKEVETIDDYDEYCHYVAGLVGLGLSKLFHASGSEDLAPDDLSNSMGLFLQKTNIIRDYLEDINEIPKSRMFWPRQIWSEYVNKLEDLKYEENSVKAVQCLNDMVTNALMHAEDCLTYMAALRDPPIFRFCAIPQIMAIGTLALCYNNIEVFRGVVKMRRGLTAKVIDRTKTMADVYGAFFDFASMLEPKVDKNDPNATKTLSRLEAIQKTCRESGLLSKRKSYIVNDESGYGSTMIVILVIMVSIIFAYLSANHHNS

SEQ ID NO: 13 - protein, 415 aa, Diospyros kaki
MGSLAAMLRHPDDVYPLVKLKMAARHAEKQIPPEPHWAFCYTMLHKVSRSFGLVIQQLGTELRNAVCIFYLVLRALDTVEDDTSIATEVKVPILLAFHHHIYDRDWHFSCGTREYKVLMDEFHHVSTAFLELGKGYQEAIEDITMRMGAGMAKFICKEVETIDDYDEYCHYVAGLVGLGLSKLFHASGLEDLAPDSLSNSMGLFLQKTNIIRDYLEDINEIPKSRMFWPRQIWSKYVNKLEDLKYEKNSVKSVQCLNDMVTNALIHVDDCLKYMSALRDPAIFRFCAIPQIMAIGTLALCYNNIEVFRGVVKMRRGLTAKVIDQTKTISDVYGAFFDFSCMLKSKVEKNDPNSTKTLSRIEAIQKTCRESGTLSKRKSYILRSKRTHNSTLIFVLFIILAILFAYLSANRPPINM

SEQ ID NO: 14 - protein, 410 aa, Euphorbia lathyris
MGSLGAILKHPDDFYPLLKLKMAAKHAEKQIPAQPHWGFCYSMLHKVSRSFSLVIQQLGTELRDAVCIFYLVLRALDTVEDDTSIPTDVKVPILIAFHKHIYDPEWHFSCGTKEYKVLMDQIHHLSTAFLELGKSYQEAIEDITKKMGAGMAKFICKEVETVDDYDEYCHYVAGLVGLGLSKLFDASGFEDLAPDDLSNSMGLFLQKTNIIRDYLEDINEIPKSRMFWPRQIWSKYVNKLEDLKYEENSVKAVQCLNDMVTNALIHMDDCLKYMSALRDPAIFRFCAIPQIMAIGTLALCYNNVEVFRGVVKMRRGLTAKVIDRTRTMADVYRAFFDFSCMMKSKVDRNDPNAEKTLNRLEAVQKTCKESGLLNKRRSYINESKPYNSTMVILLMIVLAIILAYLSKRAN

SEQ ID NO: 15 - protein, 413 aa, Camellia oleifera
MGSLGAILKHPDDFYPLMKLKMAARRAEKNIPPEPHWGFCYSMLHKVSRSFALVIQQLDTELRNAVCIFYLVLRALDTVEDDTSIATEVKVPILMAFHRHIYDRDWHFSCGTKEYKVLMDEFHHVSTAFSELGRGYQEAIEDITMRMGAGMAKFICKEVETIDDYDEYCHYVAGLVGLGLSKLFHASGSEDLASDSLSNSMGLFLQVFLLTCIKTNIIRDYLEDINEIPKSRMFWPRQIWSKYVNKLEDLKDKENSVKAVECLNDMVTNALIHVEDCLTYMSALRDPSIFRFCAIPQIMAIGTLALCYNNIEVFRGVVKMRRGLTAKVIDRTKTMSDVYGGFFDFSCMLKSKVNKSDPNAMKALSRLEAIQKICRESGTLNKRKSYIIKSEPRYNSTLVFVLFIILAILFAYL

SEQ ID NO: 16 - protein, 414 aa, Eleutherococcus senticosus
MGSLGAILKHPDDFYPLLKLKFAARHAEKQIPPEPHWAFCYSMLHKVSRSFGLVIQQLDAQLRDAVCIFYLVLRALDTVEDDTSIPTEVKVPILMAFHRHIYDKDWHFSCGTKEYKVLMDEFHHVSNAFLELGSGFQEAIEDITMRMGAGMAKFICKEVETIDDYDEYCHYVAGLVGLGLSKLFHASGAEDLATDSLSNSMGLFLQKTNIIRDYLEDINEIPKSRMFWPRQIWSKYVDKLENLKYEENSAKAVQCLNDMVTNALLHAEDCLKYMSNLRDPAIFRFCAIPQIMAIGTLALCFNNIQVFRGVVKMRRGLTAKVIDRTKTMSDVYGAFFDFSCLLKSKVDNNDPNATKTLSRLEAIQKTCKESGTLSKRKSYIIESKSAHNSALIAIIFIILAILYAYLSSNLPNNQ

SEQ ID NO: 17 - protein, 528 aa, Siraitia grosvenorii
MVDQCALGWILASALGLVIALCFFVAPRRNHRGVDSKERDECVQSAATTKGECRFNDRDVDVIVVGAGVAGSALAHTLGKDGRRVHVIERDLTEPDRIVGELLQPGGYLKLIELGLQDCVEEIDAQRVYGYALFKDGKNTRLSYPLENFHSDVSGRSFHNGRFIQRMREKAASLPNVRLEQGTVTSLLEEKGTIKGVQYKSKNGEEKTAYAPLTIVCDGCFSNLRRSLCNPMVDVPSYFVGLVLENCELPFANHGHVILGDPSPILFYQISRTEIRCLVDVPGQKVPSIANGEMEKYLKTVVAPQVPPQIYDSFIAAIDKGNIRTMPNRSMPAAPHPTPGALLMGDAFNMRHPLTGGGMTVALSDIVVLRNLLKPLKDLSDASTLCKYLESFYTLRKPVASTINTLAGALYKVFCASPDQARKEMRQACFDYLSLGGIFSNGPVSLLSGLNPRPLSLVLHFFAVAIYGVGRLLLPFPSVKGIWIGARLIYSASGIIFPIIRAEGVRQMFFPATVPAYYRSPPVFKPIV

SEQ ID NO: 18 - protein, 524 aa, Siraitia grosvenorii
MVDQCALGWILASVLGAAALYFLFGRKNGGVSNERRHESIKNIATTNGEYKSSNSDGDIIIVGAGVAGSALAYTLGKDGRRVHVIERDLTEPDRIVGELLQPGGYLKLTELGLEDCVDDIDAQRVYGYALFKDGKDTRLSYPLEKFHSDVAGRSFHNGRFIQRMREKAASLPKVSLEQGTVTSLLEENGIIKGVQYKTKTGQEMTAYAPLTIVCDGCFSNLRRSLCNPKVDVPSCFVGLVLENCDLPYANHGHVILADPSPILFYRISSTEIRCLVDVPGQKVPSISNGEMANYLKNVVAPQIPSQLYDSFVAAIDKGNIRTMPNRSMPADPYPTPGALLMGDAFNMRHPLTGGGMTVALSDVVVLRDLLKPLRDLNDAPTLSKYLEAFYTLRKPVASTINTLAGALYKVFCASPDQARKEMRQACFDYLSLGGIFSNGPVSLLSGLNPRPISLVLHFFAVAIYGVGRLLIPFPSPKRVWIGARIISGASAIIFPIIKAEGVRQMFFPATVAAYYRAPRVVKGR

SEQ ID NO: 19 - protein, 526 aa, Momordica charantia
MVDECALGWILAAALGAVIALCLFVAPKTNNQDGGVDSKATPECVQTTNGECRSDGDSDVIIVGAGVAGSALAHTLGKDGRRVHVIERDLTEPDRIVGELLQPGGYLKLIELGLADCVEEIDAQRVYGYALFKDGKNTRLSYPLEKFHSDVSGRSFHNGRFIQRMREKADSLPNVRLEQGTVTSLLEEKGTIKGVQYKSKDGKEKTAYAPLTIVCDGCFSNLRRSLCNPMVDVPSCFVGLVLENCQLPFANHGHVVLGDPSPILFYPISSTEIRCLVDVPGQKVPSISNGEMEKYLKTVVAPQVPPQIYDAFIAAIDKGNIRTMPNRSMPAAPHPTPGALLMGDAFNMRHPLTGGGMTVALSDIVVLRNLLKPLKDLHDAPTLCKYLESFYTLRKPVASTINTLAGALYKVFCASPDQARKEMRQACFDYLSLGGMFSNGPVSLLSGLNPRPLSLVLHFFAVAIYGVGRLLFPFPSPKGIWIGARLIYSASGIIFPIIKAEGVRQMFFPATVPAYYRSPPALKPVA

SEQ ID NO: 20 - protein, 529 aa, Cucurbita maxima
MVDYCAFGWILAAVLGLAIALSFFVSPRRNRRGGADSTPRSEGVRSSSTTNGECRSVDGDADVIIVGAGVAGSALAHTLGKDGRLVHVIERDLTEPDRIVGELLQPGGYLKLIELGLQDCVEEIDAQKVYGYALFKDGKNTQLSYPLEKFQSDVSGRSFHNGRFIQRMREKAASLPNVRLEQGTVTSLLEEKGTIKGVQYKSKNGEEKTAYAPLTIVCDGCFSNLRRSLCKPMVDVPSCFVGLVLENCQLPFANHGHVVLGDPSPILFYPISSTEIRCLVDVPGQKIPSISNGEMEKYLKTIVAPQVPPQIHDAFIAAIDKGNIRTMPNRSMPAAPQPTPGALLMGDAFNMRHPLTGGGMTVALSDIVVLRNLLKPLKDLNDAPTLCKYLESFYTLRKPVASTINTLAGALYKVFCASPDQARKEMRQACFDYLSLGGIFSNGPVSLLSGLNPRPLSLVLHFFAVAIYGVGRLLLPFPSPKGIWIGARLVYSASGIIFPIIKAEGVRQMFFPATVPAYYRSPPVHKSIA

SEQ ID NO: 21 - protein, 529 aa, Cucurbita moschata
MVDYCAFGWILAAVLGLAIALSFFVSPRRNRRGGADSTPRSEGVRSSSTTNGECRSVDCDADVIIVGAGVAGSALAHTLGKDGRLVHVIERDLTEPDRIVGELLQPGGYLKLIELGLQDCVEEIDAQKVYGYALFKDGKNTQLSYPLEKFQSDVSGRSFHNGRFIQRMREKAASLPNVRLEQGTVTSLLEEKGTIKGVQYKSKNGEEKTAHAPLTIVCDGCFSNLRRSLCKPMVDVPSCFVGLVLENCQLPFANHGHVVLGDPSPILFYPISSTEIRCLVDVPGQKVPSISNGEMEKYLKTIVAPQVPPQIHDAFIAAIDKGNIRTMPNRSMPAAPQPTPGALLMGDAFNMRHPLTGGGMTVALSDIVVLRNLLKPLKDLNDAPTLCKYLESFYTLRKPVASTINTLAGALYKVFCASPDQARKEMRQACFDYLSLGGIFSNGPVSLLSGLNPRPLSLVLHFFAVAIYGVGRLLLPFPSPKGIWIGARLVYSASGIIFPIIKAEGVRQMFFPATVPAYYRSPPVLKTIA

SEQ ID NO: 22 - protein, 531 aa, Cucurbita moschata
MMVDHCAFAWILDVVLGLVVAVTFFVAAPRRNRRGGTDSTASKDCVISTAIANGECKPDDADAEVIIVGAGVAGSALAYTLGKDGRRVHVIERDLTEPDRIVGEFLQPGGYLKLIELGLGDCVEEIDAQKLYGYALFKDGKNTRVSYPLGNFHSDVSGRSFHNGRFIQRMREKAASLPNVRLEQGTVTSLLETKGTIKGVQYKSKNGEEKTAYAPLTIVCDGCFSNLRRSLCKPMVDVPSCFVGLVLENCQLPFANHGHVVLGDPSPILFYPISSTEIRCLVDVPGQKVPSISNGDMEKYLKTVVAPQVPPQIHDAFIAAIEKGNVRTMPNRSMPAAPHPTPGALLMGDAFNMRHPLTGGGMTVALSDIVVLRNLLKPLKDLNDASTLCKYLESFYTLRKPVASTINTLAGALYKVFCASPDQARKEMRQACFDYLSLGGVFSNGPISLLSGLNPRPSSLVLHFFAVAIYGVGRLLLPFPSLKGIWIGARLIYSASGIILPIIKAEGVRQMFFPATVPAYYRSPPVHKPIT

SEQ ID NO: 23 - protein, 528 aa, Cucumis sativus
MVDHCTFGWIFSAFLAFVIAFSFFLSPRKNRRGRGTNSTPRRDCLSSSATTNGECRSVDGDADVIIVGAGVAGSALAHTLGKDGRRVHVIERDLTEPDRIVGELLQPGGYLKLIELGLQDCVEEIDAQKVYGYALFKDGKSTRLSYPLENFQSDVSGRSFHNGRFIQRMREKAAFLPNVRLEQGTVTSLLEEKGTITGVQYKSKNGEQKTAYAPLTIVCDGCFSNLRRSLCNPMVDVPSCFVGLVLENCQLPYANLGHVVLGDPSPILFYPISSTEIRCLVDVPGQKVPSISNGEMEKYLKTVVAPQVPPQIHDAFIAAIEKGNIRTMPNRSMPAAPQPTPGALLMGDAFNMRHPLTGGGMTVALSDIVVLRNLLKPLKDLNDAPTLCKYLESFYTLRKPVASTINTLAGALYKVFCASSDQARKEMRQACFDYLSLGGIFSNGPVSLLSGLNPRPLSLVLHFFAVAIYGVGRLLLPFPSPKGIWIGARLVYSASGIIFPIIKAEGVRQMFFPATVPAYYRTPPVFNS

SEQ ID NO: 24 - protein, 528 aa, Cucumis melo
MVDHCAFGWIFSALLAFPIALSLFLSPWRNRRVRGTDSTPRSASVSSSATTNGECRSVDGDADVVIVGAGVAGSALAHTLGKDGRRVHVIERDLTEPDRIVGELLQPGGYLKLIELGLQDCVEEIDAQKVYGYALFKDGKNTRLSYPLENFHSDVSGRSFHNGRFIQRMREKAASLPNVRLEQGTVTSLLEEKGTITGVQYKSKNGEQKTAYAPLTIVCDGCFSNLRRSLCTPMVDVPSYFVGLVLENCQLPYANLGHVVLGDPSPILFYPISSTEIRCLVDVPGQKVPSISNGEMEKYLKTVVAPQVPPQIHDAFIAAIEKGNIRTMPNRSMPAAPQPTPGALLMGDAFNMRHPLTGGGMTVALSDIVVLRNLLKPLKDLNDAPTLCKYLESFYTLRKPVASTINTLAGALYKVFCASPDQARKEMRQACFDYLSLGGIFSNGPVSLLSGLNPRPLSLVLHFFAVAIYGVGRLLLPFPSLKGIWIGARLVYSASGIIFPIIKAEGVRQMFFPATVPAYYRTPPVLNS

SEQ ID NO: 25 - protein, 533 aa, Cucurbita maxima
MMVEHCAYGWILAAVLGLVVAVTFFVAVPRRNRRGGTDSTASKDCVISPAIANGECEPEDADADADVIIVGAGVAGSALAHTLGKDGRRVHVIERDLTEPDRIVGEFLQPGGHLKLIELGLGDCVEEIDAQKLYGYALFKDGKNTRVSYPLGNFHSDVSGRSFHNGRFIQRMREKAASLPNVRLEQGTVTSLLEKKGTIKGVQYKSKNGEEKTAYAPLTIVCDGCFSNLRRSLCKPMVDVPSCFVGLVLENCRLPFANHGHVVLGDPSPILFYPISSTEIRCLVDVPGQKVPSIPNGDMEKYLKTVVAPQVPPQIHDAFIAAIEKGNIRTMPNRSMPAAPHPTPGALLMGDAFNMRHPLTGGGMTVALSDIVVLRNLLKPLKDLNDAPTLCKYLESYYTLRKPVASTINTLAGALYKVFCASPDQARKEMRQACFDYLSLGGVFSNGPISLLSGLNPRPSCLVLHFFAVAIYGVGRLLLPFPSLKGIWIGARLIYSASGIILPIIKAEGVRQMFFPATVPAYYRSPPVHKPIT

SEQ ID NO: 26 - protein, 522 aa, Ziziphus jujube
MLDQCPLGWILASVLGLFVLCNLIVKNRNSKASLEKRSECVKSIATTNGECRSKSDDVDVIIVGAGVAGSALAHTLGKDGRRLHVIERDLTEPDRIVGELLQPGGYLKLIELGLQDCVEEIDAQRVFGYALFKDGKDTRLSYPLEKFHSDVSGRSFHNGRFIQRMREKSASLPNVRLEQGTVTSLLEEKGTIKGVQYKTKTGQELTAFAPLTIVCDGCFSNLRRSLCNPKVDVPSCFVGLVLENCELPYANHGHVILADPSPILFYPISSTEVRCLVDVPGQKVPSISNGEMAKYLKSVVAPQIPPQIYDAFIAAVDKGNIRTMPNRSMPASPFPTPGALLMGDAFNMRHPLTGGGMTVALSDIVVLRDLLKPLGDLNDAATLCKYLESFYTLRKPVASTINTLAGALYKVFCASPDQARKEMRQACFDYLSLGGIFSTGPVSLLSGLNPRPLSLVLHFFAVAIYGVGRLLLPFPSPKRIWIGARLISGASGIIFPIIKAEGVRQMFFPATVPAYYRAAPVE

SEQ ID NO: 27 - protein, 524 aa, Morus alba
MADPYTMGWILASLLGLFALYYLFVNNKNHREASLQESGSECVKSVAPVKGECRSKNGDADVIIVGAGVAGSALAHTLGKDGRRVHVIERDLAEPDRIVGELLQPGGYLKLIELGLQDCVEEIDSQRVYGYALFKDGKDTRLSYPLEKFHSDVSGRSFHNGRFIQRMREKAASLPNVQLEQGTVTSLLEENGTIKGVQYKTKTGQELTAYAPLTIVCDGCFSNLRRSLCIPKVDVPSCFVGLVLENCNLPYANHGHVVLADPSPILFYPISSTEVRCLVDVPGQKVPSISNGEMAKYLKTVVASQIPPQIYDSFVAAVDKGNIRTMPNRSMPAAPHPTPGALLMGDAFNMRHPLTGGGMTVALSDIVVLRDLLKPLRDLNDSVTLCKYLESFYTLRKPVASTINTLAGALYKVFCASPDQARKEMREACFDYLSLGGVFSEGPVSLLSGLNPRPLSLVCHFFAVAIYGVGRLLLPFPSPKRLWIGARLISGASGIIFPIIRAEGVRQMFFPATIPAYYRAPRPN

SEQ ID NO: 28 - protein, 527 aa, Juglans regia
MVDPYALGWSFASVLMGLVALYILVDKKNRSRVSSEARSEGVESVTTTTSGECRLTDGDADVIIVGAGVAGSALAHTLGKDGRRVHVIERDLTEPDRIVGELLQPGGYLKLIELGLEDCVEDIDAQRVFGYALFKDGKNTRLSYPLEKFHSDVSGRSFHNGRFIQRMREKAASLLNVRLEQGTVTSLLEENGTVKGVQYKTKDGNELTAHAPLTIVCDGCFSNLRRSLCNPQVDVPSSFVGLVLENCELPYANHGHVILADPSPILFYPISSTEVRCLVDVPGKKVPSIANGEMEKYLKNMVAPQLPPEIYDSFVAAVDRGNIRTMPNRSMPAAPHPTPGALLMGDAFNMRHPLTGGGMTVALSDIVVLRDLLKPLRDLNDAPTLCKYLESFYTLRKPVASTINTLAGALYKVFCASPDRARKEMRQACFDYLSLGGVFSMGPVSLLSGLNPRPLSLVLHFFAVAVYGVGRLLVPFPSPSRIWIGARLISGASAIIFPIIKAEGVRQMFFPATVPAYYRAPPVKRDH

SEQ ID NO: 29 - protein, 524 aa, Cucumis melo
MVDQCALGWILASVLGASALYLLFGKKNCGVLNERRRESLKNIATTNGECKSSNSDGDIIIVGAGVAGSALAYTLAKDGRQVHVIERDLSEPDRIVGELLQPGGYLKLTELGLEDCVDDIDAQRVYGYALFKDGKDTRLSYPLEKFHSDVSGRSFHNGRFIQRMREKAASLPNVRLEQGTVTSLLEENGTIKGVQYKNKSGQEMTAYAPLTIVCDGCFSNLRRSLCNPKVDVPSCFVGLILENCDLPYANHGHVILADPSPILFYPISSTEIRCLVDVPGQKVPSISNGEMANYLKNVVAPQIPPQLYNSFIAAIDKGNIRTMPNRSMPADPYPTPGALLMGDAFNMRHPLTGGGMTVALSDIVVLRDLLKPLRDLNDAPTLCKYLEAFYTLRKPVASTINTLAGALYKVFCASPDQARKEMRQACFDYLSLGGIFSNGPVSLLSGLNPRPLSLVLHFFAVAIYGVGRLLIPFPSPKRVWIGARLISGASAIIFPIIKAEGVRQMFFPKTVAAYYRAPPVVRER

SEQ ID NO: 30 - protein, 524 aa, Cucumis sativus
MVDQCALGWILASVLGASALYLLFGKKNCGVSNERRRESLKNIATTNGECKSSNSDGDIIIVGAGVAGSALAYTLAKDGRQVHVIERDLSEPDRIVGELLQPGGYLKLTELGLEDCVDEIDAQRVYGYALFKDGKDTRLSYPLEKFHSDVSGRSFHNGRFIQRMREKAASLPNVRLEQGTVTSLLEENGTIRGVQYKNKSGQEMTAYAPLTIVCDGCFSNLRRSLCNPKVDVPSCFVGLILENCDLPHANHGHVILADPSPILFYPISSTEIRCLVDVPGQKVPSISNGEMANYLKNVVAPQIPPQLYNSFIAAIDKGNIRTMPNRSMPADPYPTPGALLMGDAFNMRHPLTGGGMTVALSDIVVLRDLLKPLRDLNDAPTLCKYLEAFYTLRKPVASTINTLAGALYKVFCASPDQARKEMRQACFDYLSLGGIFSNGPVSLLSGLNPRPLSLVLHFFAVAIYGVGRLLIPFPSPKRVWIGARLISGASAIIFPIIKAEGVRQMFFPKTVAAYYRAPPIVRER

SEQ ID NO: 31 - protein, 537 aa, Juglans regia
MVDQYALGLILASVLGFVVLYNLMAKKNRIRVSSEARTEGVQTVITTTNGECRSIEGDVDVIIVGAGVAGSALAHTLGKDGRKVHVIERDLSEPDRIVGELLQPGGYLKLVELGLQDSVEDIDAQRVFGYALFKDGKNTRLSYPLEKFHSDVSGRSFHNGRFIQRMREKAASLPNIRLEQGTVTSLLEENGTIKGVQYKTKDGKELAAHAPLTIVCDGCFSNLRRSLCNPQVDVPSSFVGLVLENCELPYANHGHVVLADPSPILFYPISSTEVRCLVDVPGQKVPSISNGEMAKYLKTMVAPQVPPEIYDSFVAAVDRGNIRTMPNRSMPAAPQPTPGALLMGDAFNMRHPLTGGGMTVALSDIVVLRDLLRPLRDLNDAPTLCKYLESFYTLRKPVASTINTLAGALYKVFCASPDRARNEMRQACFDYLSLGGVFSTGPVSLLSGLNPRPLSLVLHFFAVAVYGVGRLLVPFPSPSRMWIGARLISGASAIIFPIIKAEGVRQMFFPATVPAYYRAPPVNCQARSLKPDALKGL

SEQ ID NO: 32 - protein, 523 aa, Theobroma cacao
MADSYVWGWILGSVMTLVALCGVVLKRRKGSGISATRTESVKCVSSINGKCRSADGSDADVIIVGAGVAGSALAHTLGKDGRRVHVIERDLTEPDRIVGELLQPGGYLKLIELGLEDCVEEIDAQQVFGYALFKDGKHTRLSYPLEKFHSDVSGRSFHNGRFIQRMREKSASLPNVRLEQGTVTSLLEEKGTIRGVQYKTKDGRELTAFAPLTIVCDGCFSNLRRSLCNPKVDVPSCFVGLVLENCNLPYSNHGHVILADPSPILFYPISSTEVRCLVDVPGQKVPSIANGEMANYLKTIVAPQVPPEIYNSFVAAVDKGNIRTMPNRSMPAAPYPTPGALLMGDAFNMRHPLTGGGMTVALSDIVVLRDLLRPLRDLNDAPTLCKYLESFYTLRKPIASTINTLAGALYKVFCASPDQARKEMRQACFDYLSLGGVFSTGPISLLSGLNPRPVSLVLHFFAVAIYGVGRLLLPFPSPKRIWIGARLISGASGIIFPIIKAEGVRQMFFPATVPAYYRAPPVE

SEQ ID NO: 33 - protein, 531 aa, Cucurbita moschata; identical to SEQ ID NO: 22

SEQ ID NO: 34 - protein, 525 aa, Phaseolus vulgaris
MLDTYVFGWIICAALSVFVIRNFVFAGKKCCASSETDASMCAENITTAAGECRSSMRDGEFDVLIVGAGVAGSALAYTLGKDGRQVLVIERDLSEPDRIVGELLQPGGYLKLIELGLEDCVDKIDAQQVFGYALFKDGKHIRLSYPLEKFHSDVAGRSFHNGRFIQRMREKAASLPNVRLEQGTVTSLLEEKGVIKGVQYKTKDSQELSVCAPFTIVCDGCFSNLRRSLCDPKVDVPSCFVGLVLENCELPCANHGHVILGEPSPVLFYPISSTEIRCLVDVPGQKVPSISNGEMAKYLKTVIAPQVPHELHNAFIAAVDKGSIRTMPNRSMPAAPYPTPGALLMGDAFNMRHPLTGGGMTVALSDIVVLRNLLRPLRDLNDAPSLCKYLESFYTLRKPVASTINTLAGALYKVFCASSDPARKEMRQACFDYLSLGGQFSEGPISLLSGLNPRPLTLVLHFFAVATYGVGRLLLPFPSPKRMWIGLRLISSASGIIMPIIKAEGVRQMFFPATVPAYYRNPPAA

SEQ ID NO: 35 - protein, 533 aa, Hevea brasiliensis
MKMADHYLLGWILASVMGLFAFYYIVYLLVKPEEDNNRRSLPQPRSDFVKTMTATNGECRSDDDSDVDVIIVGAGVAGAALAHTLGKDGRRVHVIERDLTEPDRIVGELLQPGGYLKLIELGLEDCVEEIDAQRVFGYALFKDGKHTQLAYPLEKFHSEVAGRSFHNGRFIQRMREKAASLPSVKLEQGTVTSLLEEKGTIKGVLYKTKTGEELTAFAPLTIVCDGCFSNLRRSLCNPKVDVPSCFVGLVLENCRLPYANNGHVILADPSPILFYPISSTEVRSLVDVPGQKVPSVSSGEMANYLKNVVAPQVPPEIYDSFVAAVDKGNIRTMPNRSMPASPYPTPGALLMGDAFNMRHPLTGGGMTVALSDIVVLRDLLKPLRDLHDAPTLCRYLESFYTLRKPVASTINTLAGALYKVFCASPDEARKEMRQACFDYLSLGGVFSTGPVSLLSGLNPRPLSLVLHFFAVAIYGVGRLLLPFPSPHRIWVGARLISGASGIIFPIIKAEGVRQMFFPATVPAYYRAPPIKCN

SEQ ID NO: 36 - protein, 529 aa, Sorghum bicolor
MAAAAAAASGVGFQLIGAAAATLLAAVLVAAVLGRRRRRARPQAPLVEAKPAPEGGCAVGDGRTDVIIVGAGVAGSALAYTLGKDGRRVHVIERDLTEPDRIVGELLQPGGYLKLIELGLEDCVEEIDAQRVLGYALFKDGRNTKLAYPLEKFHSDVAGRSFHNGRFIQRMRQKAASLPNVQLEQGTVTSLLEENGTVKGVQYKTKSGEELKAYAPLTIVCDGCFSNLRRALCSPKVDVPSCFVGLVLENCQLPHPNHGHVILANPSPILFYPISSTEVRCLVDVPGQKVPSIASGEMANYLKTVVAPQIPPEIYDSFIAAIDKGSIRTMPNRSMPAAPHPTPGALLMGDAFNMRHPLTGGGMTVALSDIVVLRNLLKPLHNLHDASSLCKYLESFYTLRKPVASTINTLAGALYKVFSASPDQARNEMRQACFDYLSLGGVFSNGPIALLSGLNPRPLSLVAHFFAVAIYGVGRLMLPLPSPKRMWIGARLISGACGIILPIIKAEGVRQMFFPATVPAYYRAAPMGE

SEQ ID NO: 37 - protein, 484 aa, Zea mays
MRKNLEEAGCAVSDGGTDVIIVGAGVAGSALAYTLGKDGRRVHVIERDLTEPDRIVGELLQPGGYLKLIELGLQDCVEEIDAQRVLGYALFKDGRNTKLAYPLEKFHSDVAGRSFHNGRFIQRMRQKAASLPNVQLEQGTVTSLLEENGTVKGVQYKTKSGEELKAYAPLTIVCDGCFSNLRRALCSPKVDVPSCFVGLVLENCQLPHPNHGHVILANPSPILFYPISSTEVRCLVDVPGQKVPSIATGEMANYLKTVVAPQIPPEIYDSFIAAIDKGSIRTMPNRSMPAAPHPTPGALLMGDAFNMRHPLTGGGMTVALSDIVVLRNLLKPLRNLHDASSLCKYLESFYTLRKPVASTINTLAGALYKVFSASPDQARNEMRQACFDYLSLGGVFSNGPIALLSGLNPRPLSLVAHFFAVAIYGVGRLMLPLPSPKRMWIGARLISGACGIILPIIKAEGVRQMFFPATVPAYYRAAPTGEKA

SEQ ID NO: 38 - protein, 524 aa, Medicago sativa
MDLYNIGWILSSVLSLFALYNLIFSGKRNYHDVNDKVKDSVTSTDAGDIQSEKLNGDADVIIVGAGIAGAALAHTLGKDGRRVHIIERDLSEPDRIVGELLQPGGYLKLVELGLQDCVDNIDAQRVFGYALFKDGKHTRLSYPLEKFHSDVSGRSFHNGRFIQRMREKAASLPNVNMEQGTVISLLEEKGTIKGVQYKNKDGQALTAYAPLTIVCDGCFSNLRRSLCNPKVDNPSCFVGLILENCELPCANHGHVILGDPSPILFYPISSTEIRCLVDVPGTKVPSISNGDMTKYLKTTVAPQVPPELYDAFIAAVDKGNIRTMPNRSMPADPRPTPGAVLMGDAFNMRHPLTGGGMTVALSDIVVLRNLLKPMRDLNDAPTLCKYLESFYTLRKPVASTINTLAGALYKVFSASPDEARKEMRQACFDYLSLGGLFSEGPISLLSGLNPRPLSLVLHFFAVAVFGVGRLLLPFPSPKRVWIGARLLSGASGIILPIIKAEGIRQMFFPATVPAYYRAPPVNAF

SEQ ID NO: 39 - protein, 437 aa, Methylomonas lenta
MKEEFDICIIGAGMAGATISAYLAPKGIKIALIDHCYKEKKRIVGELLQPGAVLSLEQMGLSHLLDGFEAQTVKGYALLQGNEKTTIPYPSQHEGIGLHNGRFLQQIRASALENSSVTQIHGKALQLLENERNEIIGVSYRESITSQIKSIYAPLTITSDGFFSNFRAHLSNNQKTVTSYFIGLILKDCEMPFPKHGHVFLSGPTPFICYPISDNEVRLLIDFPGEQLPRKNLLQEHLDTNVTPYIPECMRSSYAQAIQEGGFKVMPNHYMAAKPIVRKGAVMLGDALNMRHPLTGGGLTAVFSDIQILSAHLLAMPDFKNTDLIHEKIEAYYRDRKRANANLNILANALYAVMSNDLLKTAVFKYLQCGGANAQESIAVLAGLNRKHFSLIKQFCFLAVFGACNLLQQSISNIPKALKLLKDAFVIIKPLIKNELS

SEQ ID NO: 40 - protein, 759 aa, Siraitia grosvenorii
MWRLKVGAESVGENDEKWLKSISNHLGRQVWEFCPDAGTQQQLLQVHKARKAFHDDRFHRKQSSDLFITIQYGKEVENGGKTAGVKLKEGEEVRKEAVESSLERALSFYSSIQTSDGNWASDLGGPMFLLPGLVIALYVTGVLNSVLSKHHRQEMCRYVYNHQNEDGGWGLHIEGPSTMFGSALNYVALRLLGEDANAGAMPKARAWILDHGGATGITSWGKLWLSVLGVYEWSGNNPLPPEFWLFPYFLPFHPGRMWCHCRMVYLPMSYLYGKRFVGPITPIVLSLRKELYAVPYHEIDWNKSRNTCAKEDLYYPHPKMQDILWGSLHHVYEPLFTRWPAKRLREKALQTAMQHIHYEDENTRYICLGPVNKVLNLLCCWVEDPYSDAFKLHLQRVHDYLWVAEDGMKMQGYNGSQLWDTAFSIQAIVSTKLVDNYGPTLRKAHDFVKSSQIQQDCPGDPNVWYRHIHKGAWPFSTRDHGWLISDCTAEGLKAALMLSKLPSETVGESLERNRLCDAVNVLLSLQNDNGGFASYELTRSYPWLELINPAETFGDIVIDYPYVECTSATMEALTLFKKLHPGHRTKEIDTAIVRAANFLENMQRTDGSWYGCWGVCFTYAGWFGIKGLVAAGRTYNNCLAIRKACDFLLSKELPGGGWGESYLSCQNKVYTNLEGNRPHLVNTAWVLMALIEAGQAERDPTPLHRAARLLINSQLENGDFPQQEIMGVFNKNCMITYAAYRNIFPIWALGEYCHRVLTE

SEQ ID NO: 41 - protein, 762 aa, Momordica charantia
MWRLKVGAESVGENDEKWVKSISNHLGRQVWEFCPDAGTPQQLLQIEKARKAFQDNRFHRKQTSDLLVSIQCEKGTTNGARVPGTKLKEGEEVRKEAVKSTLERALSFYSSIQTSDGNWASDLGGPMFLLPGLVIALCVTGALNSVLSKHHRQEMCRYLYNHQNEDGGWGLHIESPSTMFGSALNYVALRLLGEDADGGEGRAMTKARAWILGHGGATAITSWGKLWLSVLGVYEWSGNNPLPPEFWLLPYFLPFHPGRMWCHCRMVYLPMSYLYGKRFVGPITPVVLSLRKELYTVPYHEIDWNKSRNTCAKEDLYYPHSKMQDILWGSIHHMYEPLFTHWPAKRLREKALKTAMQHIHYEDENTRYICLGPVNKVLNMLCCWVEDPYSEAFKLHLQRVHDYLWVAEDGMKMQGYNGSQLWDTAFSVQAIISTKLVDNYGPTLRKAHDYVKNSQIQQDCPGEPNVWFRHIHKGAWPFSTRDHGWLISDCTAEGLKASLMLSKLPSETVGEPLERNRLCDAVNVLLSLQNDNGGFASYELTRSYPWLELINPAETFGDIVIDYPYVECTSATMEALALFKKLHPGHRTKEIDTAIARAADFLENMQRTDGSWYGCWGVCFTYAGWFGIKGLVAAGRAYSNCLAIRKACDFLLSKELPGGGWGESYLSCQNKVYTNLEGNRPHLVNTAWVLMALIEAGQGERDPAPLHRAARLLINSQLENGDFPQEEIMGVFNKNCMITYAAYRNIFPIWALGEYCHRVLTE

SEQ ID NO: 42 - protein, 764 aa, Cucurbita maxima
MWRLKVGAESVGEKDEKWVKSVSNHLGRQVWEFCADAAADTPHQLLQIQNARNHFHHNRFHRKQSSDLFLAIQYEKEIAKGAKGGAVKVKEGEEVGKEAVKSTLERALGFYSAVQTSDGNWASDLGGPMFLLPGLVIALHVTGVLNSVLSKHHRVEMCRYLYNHQNEDGGWGLHIEGTSTMFGSALNYVALRLLGEDADGGDGGAMTKARAWILERGGATAITSWGKLWLSVLGVYEWSGNNPLPPEFWLLPYSLPFHPGRMWCHCRMVYLPMSYLYGKRFVGPITPKVLSLRQELYTIPYHEIDWNKSRNTCAKEDLYYPHPKMQDILWGSIYHVYEPLFTRWPGKRLREKALQAAMKHIHYEDENSRYICLGPVNKVLNMLCCWVEDPYSDAFKLHLQRVHDYLWVAEDGMRMQGYNGSQLWDTAFSIQAIVATKLVDSYAPTLRKAHDFVKDSQIQEDCPGDPNVWFRHIHKGAWPFSTRDHGWLISDCTAEGLKASLMLSKLPSTMVGEPLEKNRLCDAVNVLLSLQNDNGGFASYELTRSYPWLELINPAETFGDIVIDYPYVECTAATMEALTLFKKLHPGHRTKEIDTAIGKAANFLEKMQRADGSWYGCWGVCFTYAGWFGIKGLVAAGRTYNSCLAIRKACEFLLSKELPGGGWGESYLSCQNKVYTNLEGNKPHLVNTAWVLMALIEAGQGERDPAPLHRAARLLMNSQLENGDFVQQEIMGVFNKNCMITYAAYRNIFPIWALGEYCHRVLTE

SEQ ID NO: 43 - protein, 764 aa, Citrullus colocynthis
MWRLKVGAESVGEKEEKWLKSISNHLGRQVWEFCADQPTASPNHLQQIDNARKHFRNNRFHRKQSSDLFLAIQNEKEIANGTKGGGIKVKEEEDVRKETVKNTVERALSFYSAIQTNDGNWASDLGGPMFLLPGLVIALYVTGVLNSVLSKHHRQEMCRYLYNHQNEDGGWGLHIEGTSTMFGSALNYVALRLLGEDADGGEGGAMTKARGWILDRGGATAITSWGKLWLSVLGVYEWSGNNPLPPEFWLLPYCLPFHPGRMWCHCRMVYLPMSYLYGKRFVGPITPIVLSLRKELYTIPYHEIDWNKSRNTCAKEDLYYPHPKMQDILWGSIYHLYEPLFTRWPGKRLREKALQMAMKHIHYEDENSRYICLGPVNKVLNMLCCWVEDPYSDAFKFHLQRVPDYLWIAEDGMRMQGYNGSQLWDTAFSVQAIISTKLIDSFGTTLKKAHDFVKDSQIQQDFPGDPNVWFRHIHKGAWPFSTRDHGWLISDCTAEGLKASLMLSKLPSKIVGEPLEKSRLCDAVNVLLSLQNENGGFASYELTRSYPWLELINPAETFGDIVIDYPYVECTSATMEALTLFKKLHPGHRTKEIDTAVAKAANFLENMQRTDGSWYGCWGVCFTYAGWFGIKGLVAAGRTYSTCVAIRKACDFLLSKELPGGGWGESYLSCQNKVYTNLEGNRPHLVNTAWVLMALIEAGQAERDPAPLHRAARLLINSQLENGDFPQEEIMGVFNKNCMITYAAYRNIFPIWALGEYFHRVLTE

SEQ ID NO: 44 - protein, 764 aa, Citrullus colocynthis
MWRLKVGAESVGEKEEKWLKSISNHLGRQVWEFCAHQPTASPNHLQQIDNARNHFRNNRFHRKQSSDLFLAIQNEKEIANVTKGGGIKVKEEEDVRKETVKNTVERALSFYSAIQTNDGNWASDLGGPMFLLPGLVIALYVTGVLNSVLSKHHRQEMCRYLYNHQNEDGGWGLHIEGTSTMFGSALNYVALRLLGEDADGGEGGAMTKARSWILDRGGATAITSWGKLWLSVLGVYEWSGNNPLPPEFWLLPYCLPFHPGRMWCHCRMVYLPMSYLYGKRFVGPITPIVLSLRKELYTIPYHEIDWNRSRNTCAKEDLYYPHPKMQDILWGSIYHLYEPLFTRWPGKRLREKALQMAMKHIHYEDENSRYICLGPVNKVLNMLCCWVEDPYSDAFKFHLQRVPDYLWVAEDGMRMQGYNGSQLWDTAFSVQAIISTKLIDSFGTTLKKAHDFVKDSQIQQDCPGDPNVWFRHIHKGAWPFSTRDHGWLISDCTAEGLKASLMLSKLPSKIVGEPLEKSRLCDAVNVLLSLQNENGGFASYELTRSYPWLELINPAETFGDIVIDYPYVECTSATMEALTLFKKLHPGHRTKEIDIAVARAANFLENMQRTDGSWYGCWGVCFTYAGWFGIKGLVAAGRTYNSCVAIRKACDFLLSKELPGGGWGESYLSCQNKVYTNLEGNRPHLVNTAWVLMALIEAGQAERDPAPLHRAARLLINSQLENGDFPQEEIMGVFNKNCMITYAAYRNIFPIWALGEYFHRVLTE

SEQ ID NO: 45 - protein, 765 aa, Cucurbita moschata
MWRLKVGAESVGEKDEKWVKSVSNHLGRQVWEFCADAAAAATPRQLLQIQNARNHFHRNRFHRKQSSDLFLAIQYEKEIAEGGKGGAVKVKEEEEVGKEAVKSTLERALSFYSAVQTSDGNWASDLGGPMFLLPGLVIALYVTGVLNSVLSKHHRVEMCRYLYNHQNEDGGWGLHIEGTSTMFGSALNYVALRLLGEDADGGDDGAMTKARAWILERGGATAITSWGKLWLSVLGVYEWSGNNPLPPEFWLLPYSLPFHPGRMWCHCRMVYLPMSYLYGKRFVGPITPKVLSLRQELYTVPYHEIDWNKSRNTCAKEDLYYPHPKMQDILWGSIYHVYEPLFTRWPGKRLREKALQTAMKHIHYEDENSRYICLGPVNKVLNMLCCWVEDPYSDAFKLHLQRVHDYLWVAEDGMRMQGYNGSQLWDTAFSIQAIVATKLVDSFAPTLRKAHDFVKDSQIQEDCPGDPNVWFRHIHKGAWPFSTRDHGWLISDCTAEGLKASLMLSKLPSTMVGEPLEKNRLCDAVNVLLSLQNDNGGFASYELTRSYPWLELINPAETFGDIVIDYPYVECTAATMEALTLFKKLHPGHRTKEIDTAVGKAANFLEKMQRADGSWYGCWGVCFTYAGWFGIKGLVAAGRTYNSCLAIRKACEFLLSKELPGGGWGESYLSCQNKVYTNLEGNKPHLVNTAWVLMALIEAGQGERDPAPLHRAARLLMNSQLENGDFVQQEIMGVFNKNCMITYAAYRNIFPIWALGEYCHRVLTE

SEQ ID NO: 46 - protein, 785 aa, Cucumis sativus
MWRLKVGKESVGEKEEKWIKSISNHLGRQVWEFCAENDDDDDDEAVIHVVANSSKHLLQQQRRQSSFENARKQFRNNRFHRKQSSDLFLTIQYEKEIARNGAKNGGNTKVKEGEDVKKEAVNNTLERALSFYSAIQTSDGNWASDLGGPMFLLPGLVIALYVTGVLNSVLSKHHRQEMCRYIYNHQNEDGGWGLHIEGSSTMFGSALNYVALRLLGEDANGGECGAMTKARSWILERGGATAITSWGKLWLSVLGVYEWSGNNPLPPEFWLLPYSLPFHPGRMWCHCRMVYLPMSYLYGKRFVGPITHMVLSLRKELYTIPYHEIDWNRSRNTCAQEDLYYPHPKMQDILWGSIYHVYEPLFNGWPGRRLREKAMKIAMEHIHYEDENSRYIYLGPVNKVLNMLCCWVEDPYSDAFKFHLQRIPDYLWLAEDGMRMQGYNGSQLWDTAFSIQAILSTKLIDTFGSTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAALAKAANFLENMQRTDGSWYGCWGVCFTYAGWFGIKGLVAAGRTYNNCVAIRKACHFLLSKELPGGGWGESYLSCQNKVYTNLEGNRPHLVNTAWVLMALIEAGQGERDPAPLHRAARLLINSQLENGDFPQQEIMGVFNKNCMITYAAYRNIFPIWALGEYSHRVLTE

SEQ ID NO: 47 - protein, 774 aa, Cucumis melo
MWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 48 - protein, 647 aa, Citrullus lanatus subsp. vulgaris
DGNWASDLGGPMFLLPGLVIALYVTGVLNSVLSKHHRQEMCRYLYNHQNEDGGWGLHIEGTSTMFGSALNYVALRLLGEDADGGEGGAMTKARSWILDRGGATAITSWGKLWLSVLGVYEWSGNNPLPPEFWLLPYCLPFHPGRMWCHCRMVYLPMSYLYGKRFVGPITPIVLSLRKELYTIPYHEIDWNRSRNTCAKEDLYYPHPKMQDILWGSIYHLYEPLFTRWPGKRLREKALQMAMKHIHYEDENSRYICLGPVNKVLNMLCCWVEDPYSDAFKFHLQRVPDYLWVAEDGMRMQGYNGSQLWDTAFSVQAIISTKLIDSFGTTLKKAHDFVKDSQIQQDCPGDPNVWFRHIHKGAWPFSTRDHGWLISDCTAEGLKASLMLSKLPSEIVGEPLEKSRLCDAVNVLLSLQNENGGFASYELTRSYPWLELINPAETFGDIVIDYPYVECTSATMEALTLFKKLHPGRRTKEIDIAVARAANFLENMQRTDGSWYGCWGVCFTYAGWFGIKGLVAAGRTYNSCVAIRKACDFLLSKELPGGGWGESYLSCQNKVYTNLEGNRPHLVNTAWVLMALIEAGQAERDPAPLHRAARLLINSQLENGDFPQEEIMGVFNKNCMITYAAYRNIFPIWALGEYFHRVLTE

SEQ ID NO: 49 - protein, 761 aa, Theobroma cacao
MWRLKIGKESVGDNGAWLRSSNDHVGRQVWEFCPESGTPEELSKVEMARQSFSTDRLLKKHSSDLLMRIQYAKENQFVTNFPQVKLKEFEDVKEEATLTTLRRALNFYSTIQADDGHWPGDYGGPMFLLPGLVITLSVTGALNAVLSKEHQYEMCRYLYNHQNRDGGWGLHIEGPSTMFGTVLNYVTLRLLGEGPEGGQGAVEKACEWILEHGSATAITSWGKMWLSVLGAYEWSGNNPLPPEVWLCPYFLPIHPGRMWCHCRMVYLPMSYLYGKRFVGPITPIILSLRKELYAVPYHEVDWNKARNTCAKEDLYYPHPLVQDILWASLHYLYEPIFTRWPCKSLREKALRTVMQHIHYEDENTRYICIGPVNKVLNMLSCWVEDPYSESFKLHLPRILDYLWIAEDGMKMQGYNGSQLWDTAFAVQAIISTGLADEYGPILRKAHDFIKYSQVLEDCPGDLNFWYRHISKGAWPFSTVDHGWPISDCTSEGLKAVLLLSTLPSESVGEPLHMMRLYDAVNVILSLQNVDGGFPTYELTRSYQWLELINPAETFGDIVIDYPYVECTSAAIQALISFKKLFPEHRMEEIENCIGRAVEFIEKIQAADGSWYGSWGVCFTYAGWFGIKGLSAAGRTYNNSSNIRKACDFLLSKELATGGWGESYLSCQNKVYTNLEGARPHIVNTSWALLALIEAGQAERDPTPLHRAARILINSQMEDGDFPQEEIMGVFNKNCMISYSAYRNIFPIWALGEYTCRVLRAP

SEQ ID NO: 50 - protein, 763 aa, Ziziphus jujube
MWKLKIGAETVGEGGSDGWLRSVNSHLGRQVWEFHPELGTPEELRQIQDARDAFFNHRFHKQHSSDLLMRIQFAKENPCVANPPQVKVKDTDEVTEESVTTTLRRAINFYSTIQAHDGHWAGDYGGPMFLLPGLVITLSVTGALNAVLSKEHQCEMCRYIYNHQNEDGGWGLHIEGPSTMFGTVLNYVSLRLLGEGAEDGLGTIENARKWILDHGGATAITSWGKMWLSVLGVYEWSGNNPLPPEVWLCPYTLPFHPGRMWCHCRMVYLPMSYLYGKRFVGPITPTIRSLRKELYTAPYHEIDWNRARNECAKEDLYYPHPLVQDVLWASLHYVYEPIFMRWPAKKLREKALSTVMQHIHYEDENTRYICIGPVNKVLNMLCCWVEDPNSEAFKLHLPRISDYLWIAEDGMKMQGYNGSQLWDTAFAVQAIVSTDLAEEYGPTIRKAHEYIKNSQVLEDCPGDLNFWYRHISKGAWPFSTADHGWPISDCTAEGLKAVLLLSQLSSETVGDSLDVKRLFNAVNVILSLQNGDGGFATYELTRSYQWLELINPAETFGDIVIDYPYVECTSAALEALTLFKKSYPGHRREEVENCITNAAMFIENIQAKDGSWYGSWGVCFTYAGWFGIKGLVASGRTYENCPSIRKACDFLLSKELPSGGWGESYLSCQNKVYTNLKDNKPHIVNTAWAMLALIVARQAERDPMPLHRAARILIKSQMHDGDFPQEEIMGVFNKNCMISYAAYRNIFPIWALGEYRLHVLRSL

SEQ ID NO: 51 - protein, 762 aa, Prunus avium
MWKLKIGAETVGEGGYQWLKSVNNHLGRQVWEFNPELGSPEELQRIEDARKAFWDNRFERRHSSDLLMRIQFEKENQCVTNLPQLKVKYEEEVTEEVVKTTLRRAISFYSTIQAHDGHWPGDYGGPMFLLPGLVITLSITGALNDVLSKEHQHEMCRYLYNHQNKDGGWGLHIEGPSTMFGTALNYVTLRLFGEGADDGEGAMELARKWILDHGGVTKITSWGKMWLSVLGTYEWSGNNPLPPEVWLCPYSLPFHPGRMWCHCRMVYLPMSYLYGKRFVGPITPTIRSLRKELYGVPYHEVDWNQARNLCAKEDLYYPHPMVQDILWASLHYVYEPVFTRWPAKKLRENALQTVMQHIHYEDENTRYICIGPVNKVLNMLCCWAEDPNSDAFKLHLPRIPDYLWVAEDGMKMQGYNGSQSWDTSFAVQAIISTNLAEEFGPTLRKAHEYIKDSQVLEDCPGDLNFWYRHISKGAWPFSTADHGWPISDCTAEGLKAVLLLSKLPTGTVGESLDMKQLYDAVNVMLSLQNEDGGFATYELTRSYQWLELINPAETFGDIVIDYPYVECTSAAIQALTMFRKLYPGHRREEIESCIARAAKFIEKIQATDGSWYGSWGVCFTYAGWFGIKGLAAAGRTYKDCSSIRKACDFLLSKELPSGGWGESYLSCQNKVYTNLKDNRPHIVHTAWAMLALIGAGQAKRDPTPLHRAARVLINSQMENGDFPQKEIMGVFNKNCMISYSAYRNIFPIWALGEYRCQVLEAL

SEQ ID NO: 52 - protein, 759 aa, Brassica napus
MWKLKIAEGGSPWLRTTNNHVGRQFWEFDPNLGTPEELAAVEEARKSFRENRFAKKHSSDLLMRLQFSRESLSRPVLPQVNIKDGDDVTEKMVETTLKRGVDFYSTIQASDGHWAGDYGGPMFLLPGLIITLSITGALNTVLSEQHKAEMRRYLHNHQNEDGGWGLHIEGPSTMFGSVLNYVTLRLLGEGPNDGDGAMEKGRDWILNHGGATNITSWGKMWLSVLGAFEWSGNNPLPPEIWLLPYILPIHPGRMWCHCRMVYLPMSYLYGKRFVGPITSTVLSLRKELFTVPYHEVDWNEARNLCAKEDLYYPHPLVQDILWASLHKIVEPVLTRWPGSNLREKALRTTLEHIHYEDENTRYICIGPVNKVLNMLCCWVEDPNSEAFKLHLPRIHDYLWVAEDGMKMQGYNGSQLWDTSFAVQAVLATNFVEEYGPVLKKAHSYVKNSQVSEDCPGDLSYWYRHISKGAWPFSTADHGWPISDCTAEGLKAALLLSKVPKEIVGEPVDTKRLYDAVNVIISLQNADGGFATYELTRSYPWLELINPAETFGDIVIDYPYVECTSAAIQALIAFRKLYPGHRKKEVDECIEKAVKFIESIQESDGSWYGSWAVCFTYGTWFGVKGLEAAGKTLKNSPTVAKACEFLLSKQLPSGGWGESYLSCQDKVYSNLDGNRSHVVNTAWALLSLIGAGQVEVDQKPLHRAARYLINAQMESGDFPQQEIMGVFNRNCMITYAAYRNIFPIWALGEYRSKVLLQQGE

SEQ ID NO: 53 - protein, 756 aa, Spinacia oleracea
MWKLKIAEGGSPWLRTTNNHVGRQIWEFDPNLGTPEQIREVEEARENFWKNRFEQKHSSDLLMRMQFAQENSSNVVLPQVKVKDEDEITEETVATTLRRALSYQSTIQAHDGHWPGDYGGPMFLMPGLVIALSVTGALNAVLSKEHQKEMCRYLYNHQNKDGGWGLHIEGHSTMFGTVLTYVTLRLLGEGVDDGDGAMERGRKWTLEHGSATAITSWGKMWLSVLGVFEWAGNNPMPPETWLLPYILPVHPGRMWCHCRMVYLPMSYLYGKRFVGPITPTVLSLRRELFDVPYHEIDWDRARNECAKEDLYYPHPLVQDILWASLHKAVEPILMRWPGKKLREKALSTVMEHIHYEDENTRYICIGPVNKVLNMLCCWVEDPNSEAFKLHLPRIPDFLWIAEDGMKMQGYNGSQLWDTTFMVQAILATNLGEEYGGTLRKAHNFIKDSQVREDCPGDLSYWYRHISKGAWPFSTADHGWPISDCTAEGLKAALLLSKVPSDIVGEPLEVKRLYDSVNVLLSLQNGDGGFATYELTRSYPWLELINPAETFGDIVIDYPYVECTSAAIQALVSFKRLYPGHRREEIENCIKKAAKFIEDIQAADGSWYGSWAVCFTYATWFGIKGLVAAGKNYDNCPAIRKACDFLLSKQLSNGGWGESYLSCQNKVYSNIEGNKAHVVNTGWAMLALIGAGQAKRDPMPLHRAAKVLINSQMPNGDFPQQEIMGVFNRNCMITYAAYRNIFPTWALGEYRTQVLQK

SEQ ID NO: 54 - protein, 756 aa, Trigonella foenum-graecum
  misc_feature (425)..(425): Xaa can be any naturally occurring amino acid
MWKLKVAEGGSPWLRTVNNYVGRQVWEFDPNSGSPQELDQIESVRQNFHNNRFSHKHSDDLLMRIQLAKENPMGEVIPKVRVKDVEDVNEESVTTTLRRALNFYSTLQSRDGHWPGDYGGPMFLMPGLVIALSITGALNAVLTDEHQKEMRRYLYNHQNKDGGWGLHIEGPSTMFGSVLCYVTLRLLGEGPNDGEGEMEKARDWILEHGGATYITSWGKMWLSVLGVFEWSGNNPLPPEIWLLPYMLPIHPGRMWCHCRMVYLPMSYLYGKRFVGPITPTVLSLRKELFTVPYHDIDWNQARNLCAKEDLYYPHPLVQDILWASLHKFVEPIFMNWPGKKLREKAVETVMEHVHYEDENTRYICIGPVNKVLNMLCCWVEDPNSEAFKLHLPRIHDFLWIAEDGMKMQGYNGSQLWDTAFAVQAXISTNLIDEFAPTLRKAHTFIKNSQVLEDCPGDLSKWYRHISKGAWPFSTADHGWPISDCTAEGLKAVLLLSKIGPEIVGEPLDAKGFYDAVNVIISLQNEDGGLATYELTRSYKWLEIINPAETFGDIVIDYTYVECTSAAIQALSTFRKLYPGHRREEIQHCIEKAAAFIEKIQASDGSWYGSWGVCFTYGTWFGVKGLIAAGKSFSNCLSIRKACDFLLSKQLPSGGWGESYLSCQNKVYSNLESNRSHVVNTGWAMLALIEAEQAKRDPTPLHHAAVCLINSQMENGDFPQEEIMGVFNKNCMITYAAYRNIFPIWALGEYRRHVLQA

SEQ ID NO: 55 - protein, 759 aa, Ricinus communis
MWKLRIAEGSGNPWLRTTNDHIGRQVWEFDSSKIGSPEELSQIENARQNFTKNRFIHKHSSDLLMRIQFSKENPICEVLPQVKVKESEQVTEEKVKITLRRALNYYSSIQADDGHWPGDYGGPMFLMPGLIIALSITGALNAILSEEHKREMCRYLYNHQNRDGGWGLHIEGPSTMFGSVLCYVSLRLLGEGPNEGEGAVERGRNWILKHGGATAITSWGKMWLSVLGAYEWSGNNPLPPEMWLLPYILPVHPGRMWCHCRMVYLPMSYLYGKRFVGPITPTVLSLRKELYTVPYHEIDWNQARNQCAKEDLYYPHPMLQDVLWATLHKFVEPILMHWPGKRLREKAIQTAIEHIHYEDENTRYICIGPVNKVLNMLCCWVEDPNSEAFKLHLPRLYDYLWLAEDGMKMQGYNGSQLWDTAFAVQAIVSTNLIEEYGPTLKKAHSFIKKMQVLENCPGDLNFWYRHISKGAWPFSTADHGWPISDCTAEGIKALMLLSKIPSEIVGEGLNANRLYDAVNVVLSLQNGDGGFPTYELSRSYSWLEFINPAETFGDIVIDYPYVECTSAAIQALTSFRKSYPEHQREEIECCIKKAAKFMEKIQISDGSWYGSWGVCFTYGTWFGIKGLVAAGKSFGNCSSIRKACDFLLSKQCPSGGWGESYLSCQKKVYSNLEGDRSHVVNTAWAMLSLIDAGQAERDPTPLHRAARYLINAQMENGDFPQQEIMGVFNRNCMITYAAYRDIFPIWALGEYRCRVLKAS

SEQ ID NO: 56 - protein, 313 aa, Siraitia grosvenorii EPH1
MEKIEHSTIATNGINMHVASAGSGPAVLFLHGFPELWYSWRHQLLYLSSLGYRAIAPDLRGFGDTDAPPSPSSYTAHHIVGDLVGLLDQLGVDQVFLVGDWGAMMAWYFCLFRPDRVKALVNLSVHFTPRNPAISPLDGFRLMLGDDFYVCKFQEPGVAEADFGSVDTATMFKKFLTMRDPRPPIIPNGFRSLATPEALPSWLTEEDIDYFAAKFAKTGFTGGFNYYRAIDLTWELTAPWSGSEIKVPTKFIVGDLDLVYHFPGVKEYIHGGGFKKDVPFLEEVVVMEGAAHFINQEKADEINSLIYDFIKQF

SEQ ID NO: 57 - protein, 316 aa, Siraitia grosvenorii EPH2
MEKIEHTTISTNGINMHVASIGSGPAVLFLHGFPELWYSWRHQLLFLSSMGYRAIAPDLRGFGDTDAPPSPSSYTAHHIVGDLVGLLDQLGIDQVFLVGHDWGAMMAWYFCLFRPDRVKALVNLSVHFLRRHPSIKFVDGFRALLGDDFYFCQFQEPGVAEADFGSVDVATMLKKFLTMRDPRPPMIPKEKGFRALETPDPLPAWLTEEDIDYFAGKFRKTGFTGGFNYYRAFNLTWELTAPWSGSEIKVAAKFIVGDLDLVYHFPGAKEYIHGGGFKKDVPLLEEVVVVDGAAHFINQERPAEISSLIYDFIKKF

SEQ ID NO: 58 - protein, 316 aa, Siraitia grosvenorii EPH3
MDQIEHITINTNGIKMHIASVGTGPVVLLLHGFPELWYSWRHQLLYLSSVGYRAIAPDLRGYGDTDSPASPTSYTALHIVGDLVGALDELGIEKVFLVGHDWGAIIAWYFCLFRPDRIKALVNLSVQFIPRNPAIPFIEGFRTAFGDDFYMCRFQVPGEAEEDFASIDTAQLFKTSLCNRSSAPPCLPKEIGFRAIPPPENLPSWLTEEDINYYAAKFKQTGFTGALNYYRAFDLTWELTAPWTGAQIQVPVKFIVGDSDLTYHFPGAKEYIHNGGFKKDVPLLEEVVVVKDACHFINQERPQEINAHIHDFINKF

SEQ ID NO: 59 - protein, 314 aa, Momordica charantia
MEKIEHSTIAANGITIHVASVGSGPAVLLLHGFPELWYSWRHQLLFLASKGYRAIAPDLRGFGDSDAPPSPSSYTPLHIVGDLVALLDHLGIDLVFLVGHDWGAMMAWHFCLLRPDRVKALVNLSVHFMPRNPAMSPLDGMRLLLGDDFYVCRFQEPGAAEADFGSVDTATMMKKFLTMRDPRPPIIPNGFRSLETPQALPPWLTEEDIDYFAAKFAKTGFTGGFNYYRAIGRTWELTAPWTGSKIKVPAKFIVGDLDMVYHLPDAKEYIHGGGFKEDVPLLEEVVVIEGAAHFINQEKPDEISSLIYDFIKKF

SEQ ID NO: 60 - protein, 314 aa, Cucurbita moschata
MEKIEHSTIATNGINMHVASIGSGPPVLFLHGFPELWYSWRHQLLFLASKGFRAIAPDLRGFGDSDVPPSPSSYTPFHIIGDLIGLLDHLGIEQVFLVGHDWGAMMAWYFCLFRPDRVKALVNLSVHYNPRNPAISPLSRTRQFLGDDFYICKFQTPGVAEADFGSVDTATMMKKFLTIRDPSPPIIPNGFKTLKTPETLPSWLTEEDIDYFASKFTKTGFTGGFNYYRAIEQTWELTGPWSGAKIKVPTKYVVGDVDMVYHLPGAKQYIHGGGFKKDVPLLEEVVVMEGAAHFINQEKADEISAHIYDFIIKF

SEQ ID NO: 61 - protein, 316 aa, Cucurbita maxima
MENIEHTIVPTNGINMHIASIGSGPAVLFLHGFPELWYSWRHQLLFLASNGFRAIAPDLRGFGDTDVPPSPSSYTAHHIVGDLIGLLDHLGIDRVFLVGHDWGAMMAWYFCLFRPDRVRALVNLSVHYLHRHPSIKFVDGFRAFLGDDFYFCQFQEPGVAEADFGSVDTATMLKKFLTMRDPRPPMIPKEKGFRALETPDPLPSWLTEEDVDYFASKFSKTGFTGGFNYYRAFDLSWELTAPWSGSQVKVPAKFIVGDLDLVYHFPGAKEYIHGGRFKEDVPFLEEVVVIEGAAHFINQERADEISSLIYEFINKF

SEQ ID NO: 62 - protein, 316 aa, Prunus persica
MEKIEHTTVSTNGINMHIASIGTGPVVLFLHGFPELWYSWRHQLLSLSSLGYRCIAPDLRGFGDTDAPPSPASYSALHIVGDLIGLLDHLGIDQVFLVGHDWGAVIAWWFCLFRPDRVKALVNMSVAFSPRNPKRKPVDGFRALFGDDYYICRFQEPGEIEKEFAGYDTTSIMKKFLTGRSPKPPCLPKELGLRAWKTPETLPPWLSEEDLNYFASKFSKTGFVGGLNYYRALNLTWELTGPWTGLQVKVPVKFIVGDLDITYHIPGVKNYIHNGGFKRDVPFLQEVVVIEDGAHFINQERPDEISRHVYDFIQKF

SEQ ID NO: 63 - protein, 316 aa, Morus notabilis
MEKIEHSTVHTNGINMHVASVGTGPAILFLHGFPELWYSWRHQMISLSSLGYRCIAPDLRGYGDTDAPPSPTSYTSLHIVGDLVGLIDHLVIEKLFLVGHDWGAMIAWYFCLFRPDRIKALVNLSVPFFPRNPKINFVDGFRAELGDDFYICRFQEPGESEADFSSDTVAVFRRILANRDPKPPLIPKEIGFRGVYEDPVALPSWLTEDDINHFANKFNETGFTGGLNYYRALNLTWELTAAWTGARVQVPTKFIMGDLDLVYYFPGMKEYILNGGFKRDVPLLQELVIIEGAAHFINQEKPDEISSHIHHFIQKF

SEQ ID NO: 64 - protein, 316 aa, Ricinus communis
MEKIEHTTVATNGINMHVAAIGTGPEILFLHGFPELWYSWRHQLLSLSSRGYRCIAPDLRGYGDTDAPESLTGYTALHIVGDLIGLLDSMGIEQVFLVGHDWGAMMAWYLCMFRPDRIKALVNTSVAYMSRNPQLKSLELFRTVYGDDYYVCRFQEPGGAEEDFAQVDTAKLIRSVFTSRDPNPPIVPKEIGFRSLPDPPSLPSWLSEEDVNYYADKFNKKGFTGGLNYYRNIDQNWELTAPWDGLQIKVPVKFVIGDLDLTYHFPGIKDYIHNGGFKQVVPLLQEVVVMEGVAHFINQEKPEEISEHIYDFIKKF

SEQ ID NO: 65 - protein, 316 aa, Citrus unshiu
MEKIEHTTVGTNGINMHVASIGTGPVVLFIHGFPELWYSWRNQLLYLSSRGYRAIAPDLRGYGDTDAPPSVTSYTALHLVGDLIGLLDKLGIHQVFLVGHDWGALIAWYFCLFRPDRVKALVNMSVPFPPRNPAVRPLNNFRAVYGDDYYICRFQEPGEIEEEFAQIDTARLMKKFLCLRIAKPLCIPKDTGLSTVPDPSALPSWLSEEDVNYYASKFNQKGFTGPVNYYRCSDLNWELMAPWTGVQLEVPVKFIVGDQDLVYNNKGMKEYIHNGGFKKYVPYLQEVVVMEGVAHFINQEKAEEVGAHIYEFIKKF

SEQ ID NO: 66 - protein, 316 aa, Hevea brasiliensis
MEKIEHITVFTNGINMHIASIGTGPEILFLHGFPELWYSWRHQLLSLSSLGYRCIAPDLRGYGDTDAPQSVNQYTVLHIVGDLVGLLDSLGIQQVFLVGHDWGAFIAWYFCIFRPDRIKALVNTSVAFMPRNPQVKPLDGLRSMFGDDYYICQFQKPGKAEEDFAQVNTAKLIKLLFTSRDPRPPHFLKEVGLKALQDPPSQQSWLTEEDVNFYAAKFNQKGFRGGLNYYQNINMNWELAAAWTGVQIKVPVKFIIGDLDLTYHFPGIKEYIHNGGFKKDVPLLQDVVVMEGVAHFLNQEKPEEVSKHIYDFIKKF

SEQ ID NO: 67 - protein, 317 aa, Handroanthus impetiginosus
MDKIQHKIIQTNGINIHVAEIGDGPAVLFLHGFPELWYSWRHQMLFLSSRGYRAIAPDLRGYGDSDAPPCATSYTAFHIIGDLVGLLDAMGLDRVFLVGHDWGAVMAWYFCLLRPDRIKALVNLSVVFQPRNPKRKPVESMRAKLGDDYYICRFQEPGEAEEEFARVDTARLIKKLLTTRNPAPPRLPKEVGFGCLPHKPITMPSWLSEEDVQYYAAKFNQKGFTGGLNYYRAMDLSWELAAPWTGVQIKVPVKFIVGDLDITYNTPGVKEYIHKGRFKQHVPFLQELVILEGVAHFLNQEKPDEINQHIYDFIHKF

SEQ ID NO: 68 - protein, 324 aa, Camelina sativa
MEKIEHTTVSTNGINMHVASIGSGPVILFLHGFPDLWYSWRHQLLSFAALGYRAIAPDLRGYGDSDAPPSPESYTILHIVGDLVGLLDSLGVDRVFLVGHDWGAIVAWWLCMIRPDRVKALVNTSVVFNPRNPSVKPVDKFRDLFGDDYYVCRFQETGEIEEDFAQVDTKKLITRFFVSRNPRPPCIPKSVGFRGLPDPPSLPAWLTEQDVSFYGDKFSQKGFTGGLNYYRAMNLSWELTAPWAGLQIKVPVKFIVGDLDITYNIPGTKEYIHGGGLKKHVPFLQEVVVMEGVGHFLQQEKPDEVTDHIYGFFEKFRTRETSSL

SEQ ID NO: 69 - protein, 317 aa, Coffea canephora
MDKIQHRQVPVNGINLHVAEIGDGPAILFLHGFPELWYSWRHQLLSLSAKGYRALAPDLRGYGDSDAPPSPSNYTALHIVGDLVGLLDSLGLDRVFLVGHDWGAVMAWYFCLLRPDRIKALVNMSVVFTPRNPKRKPLEAMRARFGDDYYICRFQEPGEAEEEFARVDTARIIKKFLTSRRPGPLCVPKEVGFGGSPHNPIQLPSWLSEDDVNYFASKFSQKGFTGGLNYYRAMDLNWELTAPWTGLQIKVPVKFIVGDLDVTFTTPGVKEYIQKGGFKRDVPFLQELVVMEGVAHFVNQEKPEEVSAHIYDFIQKF

SEQ ID NO: 70 - protein, 318 aa, Punica granatum
MEKIQHTTVRTNGINMHVATAGSGPDSILFVHGFPELWYTWRHQMVSLAALGYRTIAPDLRGYGDTDAPPSHESYTAFHIVGDLVGLLDSMGIEKVFLVGHDWGAAIAWYFCLFRPDRIKALVNMSVVFHPRNPNRKPVDGLRAILGDDYYICRFQAPGEIEEDFARADTANIIKFFLVSRNPRPPQIPKEGFSCLANSRQMDLPSWLSEEDINYYASKFSEKGFTGGLNYYRVMNLNWELTAPFTGLQIKVPAKFMVGDLDITYNTPGTKEFIHNGGLKKHVPFLQEVVVMEGVAHFINQEKPEEVTAHIYDFIKKF

SEQ ID NO: 71 - protein, 324 aa, Arabidopsis lyrata subsp. lyrata
MEKIEHTTVSTNGINMHVASIGSGPVILFLHGFPDLWYSWRHQLLSFAALGYRAIAPDLRGYGDSDAPPSRESYTILHIVGDLVGLLNSLGVDRVFLVGHDWGAIVAWWLCMIRPDRVNALVNTSVVFNPRNPSVKPVDAFRALFGDDYYICRFQEPGEIEEDFAQVDTKKLITRFFISRNPRPPCIPKSVGFRGLPDPPSLPAWLTEEDVSFYGDKFSQKGFTGGLNYYRALNLSWELTAPWAGLQIKVPVKFIVGDLDITYNIPGTKEYIHEGGLKKHVPFLQEVVVLEGVGHFLHQEKPDEITDHIYGFFKKFRTRETASL

SEQ ID NO: 72 - protein, 316 aa, Rhinolophus sinicus
MDKIEHTTVSTNGINMHVASIGSGPVILFLHGFPDLWYSWRHQLLSFAGLGYRAIAPDLRGYGDSDSPPSHESYTILHIVGDLVGLLDSLGVDRVFLVGHDWGAVVAWWLCMIRPDRVNALVNTSVVFNPRNPSVKPVDAFKALFGEDYYVCRFQEPGEIEEDFAQVDTKKLINRFFTSRNPRPPCIPKTLGFRGLPDPPALPAWLTEQDVSFYADKFSQKGFTGGLNYYRAMNLSWELTAPWAGLQIKVPVKFIVGDLDITYNIPGTKEYIHEGGLKKHVPFLQEVVVMEGVGHFLHQEKPDEVTDHIYGFFKKF

SEQ ID NO: 73 - protein, 473 aa, Siraitia grosvenorii CYP87D18
MWTVVLGLATLFVAYYIHWINKWRDSKFNGVLPPGTMGLPLIGETIQLSRPSDSLDVHPFIQKKVERYGPIFKTCLAGRPVVVSADAEFNNYIMLQEGRAVEMWYLDTLSKFFGLDTEWLKALGLIHKYIRSITLNHFGAEALRERFLPFIEASSMEALHSWSTQPSVEVKNASALMVFRTSVNKMFGEDAKKLSGNIPGKFTKLLGGFLSLPLNFPGTTYHKCLKDMKEIQKKLREVVDDRLANVGPDVEDFLGQAFKDKESEKFISEEFIIQLLFSISFASFESISTTLTLILKLLDEHPEVVKELEVEHEAIRKARADPDGPITWEEYKSMTFTLQVINETLRLGSVTPALLRKTVKDLQVKGKIIPEGWTIMLVTASRHRDPKVYKDPHIFNPWRWKDLDSITIQKNFMPFGGGLRHCAGAEYSKVYLCTFLHILCTKYRWTKLGGGTIARAHILSFEDGLHVKFTPKE

SEQ ID NO: 74 - protein, 474 aa, Cucumis melo
MWTILLGLATLAIAYYIHWVNKWKDSKFNGVLPPGTMGLPLIGETIQLSRPSDSLDVHPFIQSKVKRYGPIFKTCLAGRPVVVSTDAEFNHYIMLQEGRAVEMWYLDTLSKFFGLDTEWLKALGLIHKYIRSITLNHFGAESLRERFLPRIEESARETLHYWSTQPSVEVKESAAAMVFRTSIVKMFSEDSSKLLTAGLTKKFTGLLGGFLTLPLNVPGTTYHKCIKDMKEIQKKLKDILEERLAKGVSIDEDFLGQAIKDKESQQFISEEFIIQLLFSISFASFESISTTLTLILNFLADHPDVAKELEAEHEAIRKARADPDGPITWEEYKSMNFTLNVICETLRLGSVTPALLRKTTKEIQIKGYTIPEGWTVMLVTASRHRDPEVYKDPDTFNPWRWKELDSITIQRNFMPFGGGLRHCAGAEYSKVYLCTFLHILFTKYRWRKLKGGKIARAHILRFEDGLYVNFTPKE

SEQ ID NO: 75 - protein, 474 aa, Cucurbita maxima
MWTIVVGLATLAVAYYIHWINKWKDSKFNGVLPPGTMGLPLIGETLQLSRPSDSLDVHPFIKKKVKRYGSIFKTCLAGRPVVVSTDAEFNNYIMLQEGRAVEMWYLDTLSKFFGLDTEWLKALGFIHKYIRSITLNHFGAESLRERFLPRIEESAKETLCYWATQPSVEVKDSAAVMVFRTSMVKMVSKDSSKLLTGGLTKKFTGLLGGFLTLPINVPGTTYNKCMKDMKEIQKKLREILEGRLASGAGSDEDFLGQAVKDKGSQKFISDDFIIQLLFSISFASFESISTTLTLILNYLADHPDVVKELEAEHEAIRNARADPDGPITWEEYKSMTFTLHVIFETLRLGSVTPALLRKTTKELQINGYTIPEGWTVMLVTASRHRDPAVYKDPHTFNPWRWKELDSITIQKNFMPFGGGLRHCAGAEYSKVYLCTFLHILFTKYRWTKLKGGKVARAHILSFEDGLHMKFTPKE

SEQ ID NO: 76 - protein, 474 aa, Cucumis sativus
MWTILLGLATLAIAYYIHWVNKWKDSKFNGVLPPGTMGLPLIGETIQLSRPSDSLDVHPFIQRKVKRYGPIFKTCLAGRPVVVSTDAEFNHYIMLQEGRAVEMWYLDTLSKFFGLDTEWLKALGLIHKYIRSITLNHFGAESLRERFLPRIEESARETLHYWSTQTSVEVKESAAAMVFRTSIVKMFSEDSSKLLTEGLTKKFTGLLGGFLTLPLNLPGTTYHKCIKDMKQIQKKLKDILEERLAKGVKIDEDFLGQAIKDKESQQFISEEFIIQLLFSISFASFESISTTLTLILNFLADHPDVVKELEAEHEAIRKARADPDGPITWEEYKSMNFTLNVICETLRLGSVTPALLRKTTKEIQIKGYTIPEGWTVMLVTASRHRDPEVYKDPDTFNPWRWKELDSITIQKNFMPFGGGLRHCAGAEYSKVYLCTFLHILFTKYRWRKLKGGKIARAHILRFEDGLYVNFTPKE

SEQ ID NO: 77 - protein, 474 aa, Cucurbita moschata
MWAIVVGLATLAVAYYIHWINKWKDSKFNGVLPPGTMGLPLVGETLQLARPSDSLDVHPFIKKKVKRYGSIFKTCLAGRPVVVSTDAEFNNYIMLQEGRAVEMWYLDTLSKFFGLDTEWLKALGFIHKYIRSITLNHFGAESLRERFLPRIEESAKETLRYWATQPSVEVKDSAAVMVFRTSMVKMVSEDSSKLLTGGLTKKFTGLLGGFLTLPINVPGTTYNKCMKDMKEIQKKLREILEGRLASGAGSDEDFLGQAIKDKGSQQFISDDFIIQLLFSISFASFESISTTLTLVLNYLADHPDVVKELEAEHEAIRNARADPDGPITWEEYKSMTFTLHVIFETLRLGSVTPALLRKTTKELQINGYTIPEGWTVMLVTASRHRDPAVYKDPHTFNPWRWKELDSITIQKNFMPFGGGLRHCAGAEYSKVYLCTFLHILFTKYRWTKLKGGKVARAHILSFEDGLHVKFTPKE

SEQ ID NO: 78 - protein, 476 aa, Prunus avium
MWTLVGLSLVALLVIYFTHWIIKWRNPKCNGVLPPGSMGLPLIGETLNLIIPSYSLDLHPFIKKRLQRYGPIFRTSLAGRPVVVTADPEFNNYIFQQEGRMVELWYLDTFSKIFVHEGDSKTNAIGMVHKYVRSIFLNHFGAERLKEKLLPQIEEFVNKSLCAWSSKASVEVKHAGSVMVFNFSAKQMISYDAEKSSDDLSEKYTKIIDGLMSFPLNIPGTAYYNCSKHQKNVTTMLRDMLKERRISPETRRGDFLDQLSIDMEKEKFLSEDFSVQLVFGGLFATFESISAVIALAFSLLADHPSVVEELTAEHEAILKNRENPNSSITWDEYKSMTFTLQVINEILRLGNVAPGLLRRALKDIPVKGFTIPEGWTIMVVTSALQLSPNTFEDPLEFNPWRWKDLDSYAVSKNFMPFGGGMRQCAGAEYSRVFLATFLHVLVTKYRWTTIKAARIARNPILGFGDGIHIKFEEKKT

SEQ ID NO: 79 - protein, 474 aa, Populus trichocarpa
MWAIGLVVVALVVIYYTHMIFKWRSPKIEGVLPPGSMGWPLIGETLQFISPGKSLDLHPFVKKRMEKYGPIFKTSLVGRPIIVSTDYEMNKYILQHEGTLVELWYLDSFAKFFALEGETRVNAIGTVHKYLRSITLNHFGVESLKESLLPKIEDMLHTNLAKWASQGPVDVKQVISVMVFNFTANKIFGYDAENSKEKLSENYTKILNSFISLPLNIPGTSFHKCMQDREKMLKMLKDTLMERLNDPSKRRGDFLDQAIDDMKTEKFLTEDFIPQLMFGILFASFESMSTTLTLTFKFLTENPRVVEELRAEHEAIVKKRENPNSRLTWEEYRSMTFTQMVVNETLRISNIPPGLFRKALKDFQVKGYTVPAGWTVMLVTPATQLNPDTFKDPVTFNPWRWQELDQVTISKNFMPFGGGTRQCAGAEYSKLVLSTFLHILVTNYSFTKIRGGDVSRTPIISFGDGIHIKFTARA

SEQ ID NO: 80 - protein, 476 aa, Prunus persica
MWTLVGLSLVGLLVIYFTHWIIKWRNPKCNGVLPPGSMGLPFIGETLNLIIPSYSLDLHPFIKKRLQRYGPIFRTSLAGRQVVVTADPEFNNYLFQQEGRMVELWYLDTFSKIFVHEGESKTNAVGMVHKYVRSIFLNHFGAERLKEKLLPQIEEFVNKSLCAWSSKASVEVKHAGSVMVFNFSAKQMISYDAEKSSDDLSEKYTKIIDGLMSFPLNIPGTAYYNCLKHQKNVTTMLRDMLKERQISPETRRGDFLDQISIDMEKEKFLSEDFSVQLVFGGLFATFESISAVLALAFSLLAEHPSVVEELTAEHEAILKNRENLNSSLTWDEYKSMTFTLQVINEILRLGNVAPGLLRRALKDIPVKGFTIPEGWTIMVVTSALQLSPNTFEDPLEFNPWRWKDLDSYAVSKNFMPFGGGMRQCAGAEYSRVFLATFLHVLVTKYRWTTIKAARIARNPILGFGDGIHIKFEEKKT

SEQ ID NO: 81 - protein, 476 aa, Populus euphratica
MWTFVLCVVAVLVVYYTHWINKWRNPTCNGVLPPGSMGLPIIGETLELIIPSYSLDLHPFIKKRIQRYGPIFRTNILGRPAVVSADPEINSYIFQNEGKLVEMWYMDTFSKLFAQSGESRTNAFGIIHKYARSLTLTHFGSESLKERLLPQVENIVSKSLQMWSSDASVDVKPAVSIMVCDFTAKQLFGYDAENSSDKISEKFTKVIDAFMSLPLNIPGTTYHKCLKDKDSTLSILRNTLKERMNSPAESRGGDFLDQIIADMDKEKFLTEDFTVNLIFGILFASFESISAALTLSLKLIGDHPSVLEELTVEHEAILKNRENPDSPLTWAEYNSMTFSLQVINETLRLGNVAPGLLRRALQDMQVKGYTIPAGWVIMVVNSALHLNPATFKDPLEFNPWRWKDFDSYAVSKNLMPFGGGRRQCAGSEFTKLFMAIFLHKLVTKYRWNIIKQGNIGRNPILGFGDGIHISFSPKDI

SEQ ID NO: 82 - protein, 475 aa, Juglans regia
MWKVGLCVVGVIVVWFTRWINKWRNPKCNGILPPGSMGPPLIGESLQLIIPSYSLDLHPFIKKRVQRYGPIFRTSVVGQPMVVSTDVEFNHYLAKQEGRLVHFWYLDSFAEIFNLEDENAISAVGLIHKYGRSIVLNHFGTDSLKKTLLSQIEEIVNKTLQTWSSLPSVEVKHAASVMAFDLTAKQCFGYDVENSAVKMSEKFLYTLDSLISFPFNIPGTVYHKCLKDKKEVLNMLRNIVKERMNSPEKYRGDFLDQITADMNKESFLTQDFIVYLLYGLLFASFESISASLSLTLKLLAEHPAVLQQLTAEHEAILKNRDNPNSSLTWDEYKSMTFTFQVINEALRLGNVAPGLLRRALKDIEFKGYTIPAGWTIMLANSAIQLNPNTYEDPLAFNPWRWQDLDPQIVSKNFMPFGGGIRQCAGAEYSKTFLATFLHVLVTKYRWTKVKGGKMARNPILWFADGIHINFALKHN

SEQ ID NO: 83 - protein, 476 aa, Pyrus x bretschneideri
MWDVVGLSFVALLVIYLTYWITQWKNPKCNGVLPPGSMGLPLIGETLNLLIPSYSLDLHPFIRKRLERYGPIFRTSLAGKPVLVSADPEFNNYVLKQEGRMVEFWYLDTFSKIFMQEGGNGTNQIGVIHKYARSIFLNHFGAECIKEKLLTQIEGSINKHLRAWSNQESVEVKKAGSIMALNFCAEHMIGYDAETATENLGEIYHRVFQGLISFPLNVPGTAYHNCLKIHKKATTMLRAMLRERRSSPEKRRGDFLDQIIDDLDQEKFLSEDFCIHLIFGGLFAIFESISTVLTLFFSLLADHPAVLQELTAEHEALLKNREDPNSALTWDEYKSMTFTLQVINETLRLVNTAPGLLRRALKDIPVKGYTIPAGWTILLVTPALHLTSNTFKDHLEFNPWRWKDLDSLVISKNFMPFGSGLRQCAGAEFSRAYLSTFLHVLVTKYRWTTIKGARISRRPMLTFGDGAHIKFSEKKN

SEQ ID NO: 84 - protein, 475 aa, Morus notabilis
MWNTICLSVVGLVVIWISNWIRRWRNPKCNGVLPPGSMGFPLIGETLPLIIPTYSLDLHPFIKNRLQRYGSIFRTSIVGRPVVISADPEFNNFLFQQEGSLVELYYLDTFSKIFVHEGVSRTNEFGVVHKYIRSIFLNHFGAERLKEKLLPEIEQMVNKTLSAWSTQASVEVKHAASVLVLDFSAKQIISYDAKKSSESLSETYTRIIQGFMSFPLNIPGTAYNQCVKDQKKIIAMLRDMLKERRASPETNRGDFLDQISKDMDKEKFLSEDFVVQLIFGGLFATFESVSAVLALGFMLLSEHPSVLEEMIAEHETILKNREHPNSLLAWGEYKSMTFTLQVINETLRLGNVAPGLLRKALKDIRVKGFTIPKGWAIMMVTSALQLSPSTFKNPLEFNPWRWKDLDSLVISKNFMPFGRGMRQCAGAEYSRAFMATFFHVLLTKYRWTTIKVGNVSRNPILRFGNGIHIKFSKKN

SEQ ID NO: 85 - protein, 475 aa, Jatropha curcas
MWIIGLCFASLLVIYCTHFFYKWRNPKCKGVLPPGSMGLPIIGETLQLIIPSYSLDHHPFIQKRIQRYGPIFRTNLVGRPVIVSADPEVNQYIFQQEGNSVEMWYLDAYAKIFQLDGESRLSAVGRVHKYIRSITLNNFGIENLKENLLPQIQDLVNQSLQKWSNKASVDVKQAASVMVFNLTAKQMFSYGVEKNSSEEMTEKFTGIFNSLMSLPLNIPGTTYHKCLKDREAMLKMLRDTLKQRLSSPDTHRGDFLDQAIDDMDTEKFLTGDCIPQLIFGILLAGFETTATTLTLAFKFLAEHPLVLEELTAEHEKILSKRENLESPLTWDEYKSMTFTHHVINETLRLANFLPGLLRKALKDIQVKNYTIPAGWTIMVVKSAMQLNPEIYKDPLAFNPWRWKDLDSYTVSKNFMPFGGGSRQCAGADYSKLFMTIFLHVLVTKYRWRKIKGGDIARNPILGFGDGLHIEVSAKN

SEQ ID NO: 86 - protein, 475 aa, Hevea brasiliensis
MLTVVLLLVGFFIIYYTYWISKWRNPNCNGVLPPGSMGFPLIGETLQLLIPSYSLDLHPFIKKRIHRYGPIFRSNLAGRPVIVSADPEFNYYILSQEGRSVEIWYLDTFSKLFRQQGESRTNVAGYVHKYLRGAFLSQIGSENLREKLLLHIQDMVNRTLCSWSNQESVEVKHSASLAVCDFTAKVLFGYDAEKSPDNLSETFTRFVEGLISFPLNIPRTAYRQCLQDRQKALSILKNVLTDRRNSVENYRGDVLDLLLNDMGKEKFLTEDFICLIMLGGLFASFESISTITTLLLKLFSAHPEVVQELEAEHEKILVSRHGSDSLSITWDEYKSMTFTHQVINETLRLGNVAPGLLRRAIKDVQFKGYTIPSGWTIMMVTSAQQVNPEVYKDPLVFNPWRWKDFDSITVSKNFTPFGGGTRQCVGAEYSRLTLSLFIHLLVTKYRWTKIKEGEIRRAPMLGFGDGIHFKFSEKE

SEQ ID NO: 87 - protein, 498 aa, Jatropha curcas
MKRAIYICLARITKQGLSLIEMLMTELLFGAFFIIFLTYWINRWRNPKCNGVLPPGSMGLPLLGETLQLLIPRYSLDLHPFIRKRIQRYGPIFRSNVAGRPIVFTADPELNHYIFIQERRLVELWYMDTFSNLFVLDGESRPTGATGYIHKYMRGLFLTHFGAERLKDKLLHQIQELIHTTLQSWCKQPTIEVKHAASAVICDFSAKFLFGYEAEKSPFNMSERFAKFAESLVSFPLNIPGTAYHQSLEDREKVMKLLKNVLRERRNSTKKSEEDVLKQILDDMEKENFITDDFIIQILFGALFAISESIPMTIALLVKFLSAQPSVVEELTAEHEEILKNKKEKGLDSSITWEDYKSMTFTLQVINETLRIANVAPGLLRRTLRDIHYKGYTIPAGWTIMVLTSSRHMNPEIYKDPVEFNPWRWKDLDSQTISKNFTPFGGGTRQCAGAEYSRAFISMFLHVLVTKYRWKNVKEGKICRGPILRIEDGIHIKLYEKH

SEQ ID NO: 88 - protein, 476 aa, Chenopodium quinoa
MWPTMGLYVATIVAICFILLELKRRNSREKQVVLPPGSKGFPLIGETLQLLVPSYSLDLPSFIRTRIQRYGPIFKTRLVGRPVVMSADPGFNRYIVQQEGKSVEMWYLDTFSKLFAQDGEARTTAAGLVHKYLRNLTLSHFGSESLRVNLLPHLESLVRNTLLGWSSKDTIDVKESALTMTIEFVAKQLFGYDSDKSKEKIGEKFGNISQGLFSLPLNIPGTTYHSCLKSQREVMDMMRTALKDRLTTPESYRGDFLDHALKDLSTEKFLSEEFILQIMFGLLFASSESTSMTLTLVLKLLSENPHVLKELEAEHERIIKNKESPDSPLTWAEVKSMTFTLQVINESLRLGNVSLGILRRTLKDIEINGYTIPAGWTIMLVTSACQYNSDIYKDPLTFNPWRWKEMQPDVIAKNFMPFGGGTRQCAGAEFAKVLMTIFLHNLVTNYRWEKIKGGEIVRTPILGFRNALRVKLTKKN

SEQ ID NO: 89 - protein, 448 aa, Spinacia oleracea
MVLLPGSKGFPFIGETLQLLLPSYSLDLPSFIRTRIQRYGPIFQTRLVGRPVVVSADPGFNRYIVQQEGKMVEMWYLDTFSKIFAQQGEGRTNAAGLVHKYLRNITFTHFGSQTLRDKLLPHLEILVRKTLHGWTSQESIDVKEAALTMTIEFVAKQLFGYDSDKSKERIGDKFANISQGLLSFPLNIPGTTYHSCLKSQREVMDMMRKTLKERLASPDTCQGDFLDHALKDLNTDKFLTEDFILQIMFGLLFASSESTSITLTLILKFLSENPHVLEELEVEHERILKNRESPDSPLTWAEVKSMTFTLQVINESLRLGNVSLGLLRRTLKDIEINGYTIPAGWTIMLVTSACQYNSDVYKDPLTFNPWRWKEMQPDVIAKNFMPFGGGTRQCAGAEFAKVLMTIFLHVLVTTYRWEKIKGGEIIRTPILGFRNGLHVKLIKKARLS

SEQ ID NO: 90 - protein, 477 aa, Manihot esculenta
MEMWSVWLYIISLIIIIATHWIYRWRNPKCNGKLPPGSMGIPFIGETIQFLIPSKSLDVPNFIKKRMNKYGPLFRTNLVGRPVIVSSDPDFNYYLLQREGKLVERWYMDSFSKLLHHDVTQIIIKHGSIHKYLRNLVLGHFGPEPLKDKLLPQLESAISQRLQDWSKQPSIEAKSASSAMIFDFTAKILFSYEPEKSGENIGEIFSNFLQGLMSIPLNIPGTAFHRCLKNQKRAIQMITEILKERRSNPEIHKGDFLDQIVEDMKKDSFWTEEFAIYMMFGLLLASFETISSTLALAIIFLTDNPPVVQKLTEEHEAILKARENRDSGLSWKEYKSLSYTHQVVNESLRLASVAPGILRRAITDIQVDGYTIPKGWTIMVVPAAVQLNPNTFEDPLVFNPSRWEDMGAVAMAKNFIAFGGGSRSCAGAEFSRVLMSVFVHVFVTNYRWTKIKGGDMVRSPALGFGNGFHIRVSEKQL

SEQ ID NO: 91 - protein, 474 aa, Olea europaea var. sylvestris
MAALDLSTVGYLIVGLLTVYITHWIYKWRNPKCNGVLPPGSMGLPLIGETIQLVIPNASLDLPPFIKKRMKRYGPIFRTNVAGRPVIITADPEFNHFLLRQDGKLVDTWSMDTFAEVFDQASQSSRKYTRHLTLNHFGVEALREKLLPQMEDMVRTTLSNWSSQESVEVKSASVTMAIDYAARQIYSGNLENAPLKISDLFRDLVDGLMSFPINIPGTAHHRCLQTHKKVREMMKDIVKTRLEEPERQYGDMLDHMIEDMKKESFLDEDFIVQLMFGLFFVTSDSISTTLALAFKLLAEHPLVLEELTAEHEAILKKREKSESHLTWNDYKSMTFTLQVINEVLRLGNIAPGFFRRALQDIPVNGYTIPSGWVIMIATAGLHLNSNQFEDPLKFNPWRWKVCKVSSVIAKCFMPFGSGMKQCAGAEYSRVLLATFIHVLTTKYRWAIVKGGKIVRSPIIRFPDGFHYKIIEKTN

SEQ ID NO: 92 - protein, 711 aa, Stevia rebaudiana
MAQSDSVKVSPFDLVSAAMNGKAMEKLNASESEDPTTLPALKMLVENRELLTLFTTSFAVLIGCLVFLMWRRSSSKKLVQDPVPQVIVVKKKEKESEVDDGKKKVSIFYGTQTGTAEGFAKALVEEAKVRYEKTSFKVIDLDDYAADDDEYEEKLKKESLAFFFLATYGDGEPTDNAANFYKWFTEGDDKGEWLKKLQYGVFGLGNRQYEHFNKIAIVVDDKLTEMGAKRLVPVGLGDDDQCIEDDFTAWKELVWPELDQLLRDEDDTSVTTPYTAAVLEYRVVYHDKPADSYAEDQTHTNGHVVHDAQHPSRSNVAFKKELHTSQSDRSCTHLEFDISHTGLSYETGDHVGVYSENLSEVVDEALKLLGLSPDTYFSVHADKEDGTPIGGASLPPPFPPCTLRDALTRYADVLSSPKKVALLALAAHASDPSEADRLKFLASPAGKDEYAQWIVANQRSLLEVMQSFPSAKPPLGVFFAAVAPRLQPRYYSISSSPKMSPNRIHVTCALVYETTPAGRIHRGLCSTWMKNAVPLTESPDCSQASIFVRTSNFRLPVDPKVPVIMIGPGTGLAPFRGFLQERLALKESGTELGSSIFFFGCRNRKVDFIYEDELNNFVETGALSELIVAFSREGTAKEYVQHKMSQKASDIWKLLSEGAYLYVCGDAKGMAKDVHRTLHTIVQEQGSLDSSKAELYVKNLQMSGRYLRDVW

SEQ ID NO: 93 - protein, 693 aa, Arabidopsis thaliana CPR1
MATSALYASDLFKQLKSIMGTDSLSDDVVLVIATTSLALVAGFVVLLWKKTTADRSGELKPLMIPKSLMAKDEDDDLDLGSGKTRVSIFFGTQTGTAEGFAKALSEEIKARYEKAAVKVIDLDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVW

SEQ ID NO: 94 - protein, 712 aa, Arabidopsis thaliana CPR2
MASSSSSSSTSMIDLMAAIIKGEPVIVSDPANASAYESVAAELSSMLIENRQFAMIVTTSIAVLIGCIVMLVWRRSGSGNSKRVEPLKPLVIKPREEEIDDGRKKVTIFFGTQTGTAEGFAKALGEEAKARYEKTRFKIVDLDDYAADDDEYEEKLKKEDVAFFFLATYGDGEPTDNAARFYKWFTEGNDRGEWLKNLKYGVFGLGNRQYEHFNKVAKVVDDILVEQGAQRLVQVGLGDDDQCIEDDFTAWREALWPELDTILREEGDTAVATPYTAAVLEYRVSIHDSEDAKFNDINMANGNGYTVFDAQHPYKANVAVKRELHTPESDRSCIHLEFDIAGSGLTYETGDHVGVLCDNLSETVDEALRLLDMSPDTYFSLHAEKEDGTPISSSLPPPFPPCNLRTALTRYACLLSSPKKSALVALAAHASDPTEAERLKHLASPAGKDEYSKWVVESQRSLLEVMAEFPSAKPPLGVFFAGVAPRLQPRFYSISSSPKIAETRIHVTCALVYEKMPTGRIHKGVCSTWMKNAVPYEKSENCSSAPIFVRQSNFKLPSDSKVPIIMIGPGTGLAPFRGFLQERLALVESGVELGPSVLFFGCRNRRMDFIYEEELQRFVESGALAELSVAFSREGPTKEYVQHKMMDKASDIWNMISQGAYLYVCGDAKGMARDVHRSLHTIAQEQGSMDSTKAEGFVKNLQTSGRYLRDVW

SEQ ID NO: 95 - protein, 713 aa, Arabidopsis thaliana
MASSSSSSSTSMIDLMAAIIKGEPVIVSDPANASAYESVAAELSSMLIENRQFAMIVTTSIAVLIGCIVMLVWRRSGSGNSKRVEPLKPLVIKPREEEIDDGRKKVTIFFGTQTGTAEGFAKALGEEAKARYEKTRFKIVDLDDYAADDDEYEEKLKKEDVAFFFLATYGDGEPTDNAARFYKWFTEGNDRGEWLKNLKYGVFGLGNRQYEHFNKVAKVVDDILVEQGAQRLVQVGLGDDDQCIEDDFTAWREALWPELDTILREEGDTAVATPYTAAVLEYRVSIHDSEDAKFNDITLANGNGYTVFDAQHPYKANVAVKRELHTPESDRSCIHLEFDIAGSGLTMKLGDHVGVLCDNLSETVDEALRLLDMSPDTYFSLHAEKEDGTPISSSLPPPFPPCNLRTALTRYACLLSSPKKSALVALAAHASDPTEAERLKHLASPAGKDEYSKWVVESQRSLLEVMAEFPSAKPPLGVFFAGVAPRLQPRFYSISSSPKIAETRIHVTCALVYEKMPTGRIHKGVCSTWMKNAVPYEKSEKLFLGRPIFVRQSNFKLPSDSKVPIIMIGPGTGLAPFRGFLQERLALVESGVELGPSVLFFGCRNRRMDFIYEEELQRFVESGALAELSVAFSREGPTKEYVQHKMMDKASDIWNMISQGAYLYVCGDAKGMARDVHRSLHTIAQEQGSMDSTKAEGFVKNLQTSGRYLRDVW

SEQ ID NO: 96 - protein, 710 aa, Stevia rebaudiana
MAQSESVEASTIDLMTAVLKDTVIDTANASDNGDSKMPPALAMMFEIRDLLLILTTSVAVLVGCFVVLVWKRSSGKKSGKELEPPKIVVPKRRLEQEVDDGKKKVTIFFGTQTGTAEGFAKALFEEAKARYEKAAFKVIDLDDYAADLDEYAEKLKKETYAFFFLATYGDGEPTDNAAKFYKWFTEGDEKGVWLQKLQYGVFGLGNRQYEHFNKIGIVVDDGLTEQGAKRIVPVGLGDDDQSIEDDFSAWKELVWPELDLLLRDEDDKAAATPYTAAIPEYRVVFHDKPDAFSDDHTQTNGHAVHDAQHPCRSNVAVKKELHTPESDRSCTHLEFDISHTGLSYETGDHVGVYCENLIEVVEEAGKLLGLSTDTYFSLHIDNEDGSPLGGPSLQPPFPPCTLRKALTNYADLLSSPKKSTLLALAAHASDPTEADRLRFLASREGKDEYAEWVVANQRSLLEVMEAFPSARPPLGVFFAAVAPRLQPRYYSISSSPKMEPNRIHVTCALVYEKTPAGRIHKGICSTWMKNAVPLTESQDCSWAPIFVRTSNFRLPIDPKVPVIMIGPGTGLAPFRGFLQERLALKESGTELGSSILFFGCRNRKVDYIYENELNNFVENGALSELDVAFSRDGPTKEYVQHKMTQKASEIWNMLSEGAYLYVCGDAKGMAKDVHRTLHTIVQEQGSLDSSKAELYVKNLQMSGRYLRDVW

SEQ ID NO: 97 - protein, 708 aa, Stevia rebaudiana CPR3
MAQSNSVKISPLDLVTALFSGKVLDTSNASESGESAMLPTIAMIMENRELLMILTTSVAVLIGCVVVLVWRRSSTKKSALEPPVIVVPKRVQEEEVDDGKKKVTVFFGTQTGTAEGFAKALVEEAKARYEKAVFKVIDLDDYAADDDEYEEKLKKESLAFFFLATYGDGEPTDNAARFYKWFTEGDAKGEWLNKLQYGVFGLGNRQYEHFNKIAKVVDDGLVEQGAKRLVPVGLGDDDQCIEDDFTAWKELVWPELDQLLRDEDDTTVATPYTAAVAEYRVVFHEKPDALSEDYSYTNGHAVHDAQHPCRSNVAVKKELHSPESDRSCTHLEFDISNTGLSYETGDHVGVYCENLSEVVNDAERLVGLPPDTYFSIHTDSEDGSPLGGASLPPPFPPCTLRKALTCYADVLSSPKKSALLALAAHATDPSEADRLKFLASPAGKDEYSQWIVASQRSLLEVMEAFPSAKPSLGVFFASVAPRLQPRYYSISSSPKMAPDRIHVTCALVYEKTPAGRIHKGVCSTWMKNAVPMTESQDCSWAPIYVRTSNFRLPSDPKVPVIMIGPGTGLAPFRGFLQERLALKEAGTDLGLSILFFGCRNRKVDFIYENELNNFVETGALSELIVAFSREGPTKEYVQHKMSEKASDIWNLLSEGAYLYVCGDAKGMAKDVHRTLHTIVQEQGSLDSSKAELYVKNLQMSGRYLRDVW

SEQ ID NO: 98 - protein, 705 aa, Artemisia annua CPR
MAQSTTSVKLSPFDLMTALLNGKVSFDTSNTSDTNIPLAVFMENRELLMILTTSVAVLIGCVVVLVWRRSSSAAKKAAESPVIVVPKKVTEDEVDDGRKKVTVFFGTQTGTAEGFAKALVEEAKARYEKAVFKVIDLDDYAAEDDEYEEKLKKESLAFFFLATYGDGEPTDNAARFYKWFTEGEEKGEWLDKLQYAVFGLGNRQYEHFNKIAKVVDEKLVEQGAKRLVPVGMGDDDQCIEDDFTAWKELVWPELDQLLRDEDDTSVATPYTAAVAEYRVVFHDKPETYDQDQLTNGHAVHDAQHPCRSNVAVKKELHSPLSDRSCTHLEFDISNTGLSYETGDHVGVYVENLSEVVDEAEKLIGLPPHTYFSVHADNEDGTPLGGASLPPPFPPCTLRKALASYADVLSSPKKSALLALAAHATDSTEADRLKFLASPAGKDEYAQWIVASHRSLLEVMEAFPSAKPPLGVFFASVAPRLQPRYYSISSSPRFAPNRIHVTCALVYEQTPSGRVHKGVCSTWMKNAVPMTESQDCSWAPIYVRTSNFRLPSDPKVPVIMIGPGTGLAPFRGFLQERLAQKEAGTELGTAILFFGCRNRKVDFIYEDELNNFVETGALSELVTAFSREGATKEYVQHKMTQKASDIWNLLSEGAYLYVCGDAKGMAKDVHRTLHTIVQEQGSLDSSKAELYVKNLQMAGRYLRDVW

SEQ ID NO: 99 - protein, 706 aa, CPR (PgCPR)
MAQSSSGSMSPFDFMTAIIKGKMEPSNASLGAAGEVTAMILDNRELVMILTTSIAVLIGCVVVFIWRRSSSQTPTAVQPLKPLLAKETESEVDDGKQKVTIFFGTQTGTAEGFAKALADEAKARYDKVTFKVVDLDDYAADDEEYEEKLKKETLAFFFLATYGDGEPTDNAARFYKWFLEGKERGEWLQNLKFGVFGLGNRQYEHFNKIAIVVDEILAEQGGKRLISVGLGDDDQCIEDDFTAWRESLWPELDQLLRDEDDTTVSTPYTAAVLEYRVVFHDPADAPTLEKSYSNANGHSVVDAQHPLRANVAVRRELHTPASDRSCTHLEFDISGTGIAYETGDHVGVYCENLAETVEEALELLGLSPDTYFSVHADKEDGTPLSGSSLPPPFPPCTLRTALTLHADLLSSPKKSALLALAAHASDPTEADRLRHLASPAGKDEYAQWIVASQRSLLEVMAEFPSAKPPLGVFFASVAPRLQPRYYSISSSPRIAPSRIHVTCALVYEKTPTGRVHKGVCSTWMKNSVPSEKSDECSWAPIFVRQSNFKLPADAKVPIIMIGPGTGLAPFRGFLQERLALKEAGTELGPSILFFGCRNSKMDYIYEDELDNFVQNGALSELVLAFSREGPTKEYVQHKMMEKASDIWNLISQGAYLYVCGDAKGMARDVHRTLHTIAQEQGSLDSSKAESMVKNLQMSGRYLRDVW

SEQ ID NO: 100 - protein, 348 aa, Acetobacter pasteurianus subsp. ascendens
MSVSKTTETFTSIPVIDISKLYSSDLAERKAVAEKLGDAARNIGFLYISGHNVSADLIEGVRKAARDFFAEPFEKKMEYYIGTSATHKGFVPEGEEVYSAGRPDHKEAFDIGYEVPANHPLVQAGTPLLGPNNWPDIPGFRSAAEAYYRTVFDLGRTLFRGFALALGLNESYFDTVANFPPSKLRMIHYPYDADAQDAPGIGAHTDYECFTILLADKPGLEVMNGNGDWIDAPPIPGAFVVNIGDMLEVMTAGEFVATAHRVRKVSEERYSFPLFYACDYHTQIRPLPAFAKKIDASYETITIGEHMWAQALQTYQYLVKKVEKGELKLPKGARKTATFGHFKRNSAA

SEQ ID NO: 101 - protein, 321 aa, Cucurbita maxima
MAAASSFSAAFYSGIPLIDLSAPDAKQLIVKACEELGFFKVVKHGVPMELISSLESESTKFFSLPLSEKQRAGPPSPFGYGNKQIGRNGDVGWVEYLLLNTHLESNSDGFLSMFGQDPQKLRSAVNDYISAVRNMAGEILELMAEGLKIQQRNVFSKLVMDEQSDSVFRVNHYPPCPDLQALKGTNMIGFGEHTDPQIISVLRSNNTSGFQISLADGNWISVPPDHSSFFINVGDSLQVMTNGRFKSVKHRVLTNSSKSRVSMIYFGGPPLSEKIAPLASLMQGEERSLYKEFTWFEYKRSAYNSRLADNRLVPFERIAAS

SEQ ID NO: 102 - protein, 353 aa, Dendrobium catenatum
MPSLSKEHFDLYSAFHVPETHAWSSSHLHDHPIAGDGATIPVIDISDPDAASMVGGACRSWGVFYATSHGIPADLLHQVESHARRLFSLPLHRKLQTAPRDGSLSGYGRPPISAFFPKLMWSEGFTLAGHDDHLAVTSQLSPFDSLSFCEVMEAYRKEMKKLAGRLFRLLILSLGLEEEEMGQVGPLKELSQAADAIQLNSYPTCPEPERAIGMAAHTDSAFLTVLHQTDGAGGLQVLRDQDESGSARWVDVLPRPDCLVVNVGDLLHILSNGRFKSVRHRAVVNRADHRISAAYFIGPPAHMKVGSITKLVDMRTGPMYRPVTWPEYLGIRTRLFDKALDSVKFQEKELEKD

SEQ ID NO: 103 - protein, 377 aa, Cucurbita maxima
MATTIADVFKSFPVHIPAHKNLDFDSLHELPDSYAWIQPDSFPSPTHKHHNSILDSDSDSVPLIDLSLPNAAALIGNAFRSWGAFQVINHGVPISLLQSIESSADTLFSLPPSHKLKAARTPDGISGYGLVRISSFFPKRMWSEGFTIVGSPLDHFRQLWPHDYHKHCEIVEEYDREMRSLCGRLMWLGLGELGITRDDMKWAGPDGDFKTSPAATQFNSYPVCPDPDRAMGLGPHTDTSLLTIVYQSNTRGLQVLREGKRWVTVEPVAGGLVVQVGDLLHILTNGLYPSALHQAVVNRTRKRLSVAYVFGPPESAEISPLKKLLGPTQPPLYRPVTWTEYLGKKAEHFNNALSTVRLCAPITGLLDVNDHSRVKVG

SEQ ID NO: 104 - protein, 378 aa, Cucurbita maxima
MHVVTSTPEARHDGAPLVFDASVLRHQHNIPKQFIWPDEEKPAATCPELEVPLIDLSGFLSGEKDAAAEAVRLVGEACEKHGFFLVVNHGVDRKLIGEAHKYMDEFFELPLSQKQSAQRKAGEHCGYASSFTGRFSSKLPWKETLSFRFAADESLNNLVLHYLNDKLGDQFAKFGRVYQDYCEAMSGLSLGIMELLGKSLGVEEQCFKNFFKDNDSIMRLNFYPPCQKPHLTLGTGPHCDPTSLTILHQDQVGGLQVFVDNQWRLITPNFDAFVVNIGDTFMALSNGRYKSCLHRAVVNSERTRKSLAFFLCPRNDKVVRPPRELVDTQNPRRYPDFTWSMLLRFTQTHYRADMKTLEAFSAWLQQEQQEQQEQQFNI

SEQ ID NO: 105 - protein, 361 aa, Agapanthus praecox subsp. orientalis
MVLQPFVFDAALLRDEHNIPTQFIWPEEDKPSPDASEELILPFIDLKAFLSGDPDSPFQVSKQVGEACESLGAFQVTNHGIDFDLLEEAHSCIQKFFSMPLCEKQRALRKAGESYGYASSFTGRFCSKLPWKETLSFRYSSSSSDIVQNYFVRTLGEEFRHFGEVYQKYCESMSKLSLMIMEVLGLSLGVGRMHFREFFEGNDSTMRLNYYPPCKKPDLTLGTGPHCDPTSLTILHQDDVSGLQVFTGGKWLTVRPKTDAFVVNIGDTFTALSNGRYKSCLHRAVVNSKTARKSLAFFLCPAMNKIVRPPRELVDIDHPRAYPDFTWSALLEFTQKHYRADMQTLNEFSKYILQAQGTLHK

SEQ ID NO: 106 - protein, 358 aa, Arabidopsis thaliana
MAPGTLTELAGESKLNSKFVRDEDERPKVAYNVFSDEIPVISLAGIDDVDGKRGEICRQIVEACENWGIFQVVDHGVDTNLVADMTRLARDFFALPPEDKLRFDMSGGKKGGFIVSSHLQGEAVQDWREIVTYFSYPVRNRDYSRWPDKPEGWVKVTEEYSERLMSLACKLLEVLSEAMGLEKESLTNACVDMDQKIVVNYYPKCPQPDLTLGLKRHTDPGTITLLLQDQVGGLQATRDNGKTWITVQPVEGAFVVNLGDHGHFLSNGRFKNADHQAVVNSNSSRLSIATFQNPAPDATVYPLKVREGEKAILEEPITFAEMYKRKMGRDLELARLKKLAKEERDHKEVDKPVDQIFA

SEQ ID NO: 107 - protein, 376 aa, Chrysosplenium americanum
QEKTLNSRFVARDEDSLERPKVSAIYNGSFDEIPVLISLAGIDMTGAGTDAAARRSEICRKIVEACEDWGIFGEIDDDHGKRAEICDKIVKACEDWGVFQPDEKLESVMSAAKKGDFVVDHGVDAEVISQWTTFAKPTSHTQFETETTRDFPNKPEGWKATTEQYSRTLMGLACKLLGVISEAMGLEKEALTKACVDMDQKVVVNYYPKCPQPDLTLGLKRHTDPGTITLLLQDQVGGLQATRDGGKTWITVQPVKDNGWILLHIGDSNGHRHGHFLSNGRFKSHQAYRYRRPTRGSPTFGTKVSNYPPCPEQSLVRPPAGRPYGRALNALDAKKLASAKQQLESAAILLISELAVAYIILAILPSSEIIAEEGYL

SEQ ID NO: 108 - protein, 347 aa, Datura stramonium
MATFVSNWSTNNVSESFIAPLEKRAEKDVALGNDVPIIDLQQDHLLIVQQITKACQDFGLFQVINHGVPEKLMVEAMEVYKEFFALPAEEKEKFQPKGEPAKFELPLEQKAKLYVEGERRCNEEFLYWKDTLAHGCYPLHEELLNSWPEKPPTYRDVIAKYSVEVRKLTMRILDYICEGLGLKLGYFDNELTQIQMLLANYYPSCPDPSSTIGSGGHYDGNLITLLQQDLVGLQQLIVKDDKWIAVEPIPTAFVVNLGLTLKVMSNEKFEGSIHRVVTHPTRNRISIGTLIGPDYSCTIEPIKELLSQENPPLYKPYPYAKFAEIYLSDKSDYDAGVKPYKINQFPN

SEQ ID NO: 109 - protein, 329 aa, Arabidopsis thaliana
MENHTTMKVSSLNCIDLANDDLNHSVVSLKQACLDCGFFYVINHGISEEFMDDVFEQSKKLFALPLEEKMKVLRNEKHRGYTPVLDELLDPKNQINGDHKEGYYIGIEVPKDDPHWDKPFYGPNPWPDADVLPGWRETMEKYHQEALRVSMAIARLLALALDLDVGYFDRTEMLGKPIATMRLLRYQGISDPSKGIYACGAHSDFGMMTLLATDGVMGLQICKDKNAMPQKWEYVPPIKGAFIVNLGDMLERWSNGFFKSTLHRVLGNGQERYSIPFFVEPNHDCLVECLPTCKSESELPKYPPIKCSTYLTQRYEETHANLSIYHQQT

SEQ ID NO: 110 - protein, 511 aa, Solanum lycopersicum
MALRINELFVAAIIYIIVHIIISKLITTVRERGRRLPLPPGPTGWPVIGALPLLGSMPHVALAKMAKKYGPIMYLKVGTCGMVVASTPNAAKAFLKTLDINFSNRPPNAGATHLAYNAQDMVFAPYGPRWKLLRKLSNLHMLGGKALENWANVRANELGHMLKSMFDASQDGECVVIADVLTFAMANMIGQVMLSKRVFVEKGVEVNEFKNMVVELMTVAGYFNIGDFIPKLAWMDIQGIEKGMKNLHKKFDDLLTKMFDEHEATSNERKENPDFLDVVMANRDNSEGERLSTTNIKALLLNLFTAGTDTSSSVIEWALAEMMKNPKIFEKAQQEMDQVIGKNRRLIESDIPNLPYLRAICKETFRKHPSTPLNLPRVSSEPCTVDGYYIPKNTRLSVNIWAIGRDPDVWENPLEFTPERFLSGKNAKIEPRGNDFELIPFGAGRRICAGTRMGIVMVEYILGTLVHSFDWKLPNNVIDINMEESFGLALQKAVPLEAMVTPRLSLDVYRC

SEQ ID NO: 111 - protein, 401 aa, D4H
MPKSWPIVISSHSFCFLPNSEQERKMKDLNFHAATLSEEESLRELKAFDETKAGVKGIVDTGITKIPRIFIDQPKNLDRISVCRGKSDIKIPVINLNGLSSNSEIRREIVEKIGEASEKYGFFQIVNHGIPQDVMDKMVDGVRKFHEQDDQIKRQYYSRDRFNKNFLYSSNYVLIPGIACNWRDTMECIMNSNQPDPQEFPDVCRDILMKYSNYVRNLGLILFELLSEALGLKPNHLEEMDCAEGLILLGHYYPACPQPELTFGTSKHSDSGFLTILMQDQIGGLQILLENQWIDVPFIPGALVINIADLLQLITNDKFKSVEHRVLANKVGPRISVAVAFGIKTQTQEGVSPRLYGPIKELISEENPPIYKEVTVKDFITIRFAKRFDDSSSLSPFRLNN

SEQ ID NO: 112 - protein, 372 aa, Catharanthus roseus
MKELNNSEEELKAFDDTKAGVKALVDSGITEIPRIFLDHPTNLDQISSKDREPKFKKNIPVIDLDGISTNSEIRREIVEKIREASEKWGFFQIVNHGIPQEVMDDMIVGIRRFHEQDNEIKKQFYTRDRTKSFRYTSNFVLNPKIACNWRDTFECTMAPHQPNPQDLPDICRDIMMKYISYTRNLGLTLFELLSEALGLKSNRLKDMHCDEGVELVGHYYPACPQPELTLGTSKHTDTGFLTMLQQDQIGGLQVLYENHQWVDVPFIPGALIINIGDFLQIISNDKFKSAPHRVLANKNGPRISTASVFMPNFLESAEVRLYGPIKELLSEENPPIYEQITAKDYVTVQFSRGLDGDSFLSPFMLNKDNMEK

SEQ ID NO: 113 - protein, 374 aa, Zea mays
MAPTTATKDDSGYGDERRRELQAFDDTKLGVKGLVDSGVKSIPSIFHHPPEALSDIISPAPLPSSPPSGAAIPVVDLSVTRREDLVEQVRHAAGTVGFFWLVNHGVAEELMGGMLRGVRQFNEGPVEAKQALYSRDLARNLRFASNFDLFKAAAADWRDTLFCEVAPNPPPREELPEPLRNVMLEYGAAVTKLARFVFELLSESLGMPSDHLYEMECMQNLNVVCQYYPPCPEPHRTVGVKRHTDPGFFTILLQDGMGGLQVRLGNNGQSGGCWVDIAPRPGALMVNIGDLLQLVTNDRFRSVEHRVPANKSSDTARVSVASFFNTDVRRSERMYGPIPDPSKPPLYRSVRARDFIAKFNTIGLDGRALDHFRL

SEQ ID NO: 114 - protein, 338 aa, Hordeum vulgare subsp. vulgare
MAKVMNLTPVHASSIPDSFLLPADRLHPATTDVSLPIIDMSRGRDEVRQAILDSGKEYGFIQVVNHGISEPMLHEMYAVCHEFFDMPAEDKAEFFSEDRSERNKLFCGSAFETLGEKYWIDVLELLYPLPSGDTKDWPHKPQMLREVVGNYTSLARGVAMEILRLLCEGLGLRPDFFVGDISGGRVVVDINYYPPSPNPSRTLGLPPHCDRDLMTVLLPGAVPGLEIAYKGGWIKVQPVPNSLVINFGLQLEVVTNGYLKAVEHRAATNFAEPRLSVASFIVPADDCVVGPAEEFVSEDNPPRYRTLTVGEFKRKHNVVNLDSSINQIININNNQKGI

SEQ ID NO: 115 - protein, 339 aa, Hordeum vulgare subsp. vulgare
MENILHATPAPVSLPESFVFASDKVPPATKAVVSLPIIDLSCGRDEVRRSILEAGKELGFFQVVNHGVSKQVMRDMEGMCEQFFHLPAADKASLYSEERHKPNRLFSGATYDTGGEKYWRDCLRLACPFPVDDSINEWPDTPKGLRDVIEKFTSQTRDVGKELLRLLCEGMGIRADYFEGDLSGGNVILNINHYPSCPNPDKALGQPPHCDRNLITLLLPGAVNGLEVSYKGDWIKVDPAPNAFVVNFGQQLEVVTNGLLKSIEHRAMTNSALARTSVATFIMPTQECLIGPAKEFLSKENPPCYRTTMFRDFMRIYNVVKLGSSLNLTTNLKNVQKEI

SEQ ID NO: 116 - protein, 523 aa, Siraitia grosvenorii UGT720-269-1
MEDRNAMDMSRIKYRPQPLRPASMVQPRVLLFPFPALGHVKPFLSLAELLSDAGIDVVFLSTEYNHRRISNTEALASRFPTLHFETIPDGLPPNESRALADGPLYFSMREGTKPRFRQLIQSLNDGRWPITCIITDIMLSSPIEVAEEFGIPVIAFCPCSARYLSIHFFIPKLVEEGQIPYADDDPIGEIQGVPLFEGLLRRNHLPGSWSDKSADISFSHGLINQTLAAGRASALILNTFDELEAPFLTHLSSIFNKIYTIGPLHALSKSRLGDSSSSASALSGFWKEDRACMSWLDCQPPRSVVFVSFGSTMKMKADELREFWYGLVSSGKPFLCVLRSDVVSGGEAAELIEQMAEEEGAGGKLGMVVEWAAQEKVLSHPAVGGFLTHCGWNSTVESIAAGVPMMCWPILGDQPSNATWIDRVWKIGVERNNREWDRLTVEKMVRALMEGQKRVEIQRSMEKLSKLANEKVVRGINLHPTISLKKDTPTTSEHPRHEFENMRGMNYEMLVGNAIKSPTLTKK

SEQ ID NO: 117 - protein, 473 aa, Siraitia grosvenorii UGT94-289-3
MTIFFSVEILVLGIAEFAAIAMDAAQQGDTTTILMLPWLGYGHLSAFLELAKSLSRRNFHIYFCSTSVNLDAIKPKLPSSFSDSIQFVELHLPSSPEFPPHLHTTNGLPPTLMPALHQAFSMAAQHFESILQTLAPHLLIYDSLQPWAPRVASSLKIPAINFNTTGVFVISQGLHPIHYPHSKFPFSEFVLHNHWKAMYSTADGASTERTRKRGEAFLYCLHASCSVILINSFRELEGKYMDYLSVLLNKKVVPVGPLVYEPNQDGEDEGYSSIKNWLDKKEPSSTVFVSFGSEYFPSKEEMEEIAHGLEASEVNFIWVVRFPQGDNTSGIEDALPKGFLERAGERGMVVKGWAPQAKILKHWSTGGFVSHCGWNSVMESMMFGVPIIGVPMHVDQPFNAGLVEEAGVGVEAKRDPDGKIQRDEVAKLIKEVVVEKTREDVRKKAREMSEILRSKGEEKFDEMVAEISLLLKI

SEQ ID NO: 118 - protein, 460 aa, Siraitia grosvenorii UGT74-345-2
MDETTVNGGRRASDVVVFAFPRHGHMSPMLQFSKRLVSKGLRVTFLITTSATESLRLNLPPSSSLDLQVISDVPESNDIATLEGYLRSFKATVSKTLADFIDGIGNPPKFIVYDSVMPWVQEVARGRGLDAAPFFTQSSAVNHILNHVYGGSLSIPAPENTAVSLPSMPVLQAEDLPAFPDDPEVVMNFMTSQFSNFQDAKWIFFNTFDQLECKKQSQVVNWMADRWPIKTVGPTIPSAYLDDGRLEDDRAFGLNLLKPEDGKNTRQWQWLDSKDTASVLYISFGSLAILQEEQVKELAYFLKDTNLSFLWVLRDSELQKLPHNFVQETSHRGLVVNWCSQLQVLSHRAVSCFVTHCGWNSTLEALSLGVPMVAIPQWVDQTTNAKFVADVWRVGVRVKKKDERIVTKEELEASIRQVVQGEGRNEFKHNAIKWKKLAKEAVDEGGSSDKNIEEFVKTIA

SEQ ID NO: 119 - protein, 486 aa, Siraitia grosvenorii UGT75-281-2
MGDNGDGGEKKELKENVKKGKELGRQAIGEGYINPSLQLARRLISLGVNVTFATTVLAGRRMKNKTHQTATTPGLSFATFSDGFDDETLKPNGDLTHYFSELRRCGSESLTHLITSAANEGRPITFVIYSLLLSWAADIASTYDIPSALFFAQPATVLALYFYYFHGYGDTICSKLQDPSSYIELPGLPLLTSQDMPSFFSPSGPHAFILPPMREQAEFLGRQSQPKVLVNTFDALEADALRAIDKLKMLAIGPLIPSALLGGNDSSDASFCGDLFQVSSEDYIEWLNSKPDSSVVYISVGSICVLSDEQEDELVHALLNSGHTFLWVKRSKENNEGVKQETDEEKLKKLEEQGKMVSWCRQVEVLKHPALGCFLTHCGWNSTIESLVSGLPVVAFPQQIDQATNAKLIEDVWKTGVRVKANTEGIVEREEIRRCLDLVMGSRDGQKEEIERNAKKWKELARQAIGEGGSSDSNLKTFLWEIDLEI

SEQ ID NO: 120 - protein, 485 aa, Siraitia grosvenorii UGT720-269-4
MAEQAHDLLHVLLFPFPAEGHIKPFLCLAELLCNAGFHVTFLNTDYNHRRLHNLHLLAARFPSLHFESISDGLPPDQPRDILDPKFFISICQVTKPLFRELLLSYKRISSVQTGRPPITCVITDVIFRFPIDVAEELDIPVFSFCTFSARFMFLYFWIPKLIEDGQLPYPNGNINQKLYGVAPEAEGLLRCKDLPGHWAFADELKDDQLNFVDQTTASSRSSGLILNTFDDLEAPFLGRLSTIFKKIYAVGPIHSLLNSHHCGLWKEDHSCLAWLDSRAAKSVVFVSFGSLVKITSRQLMEFWHGLLNSGKSFLFVLRSDVVEGDDEKQVVKEIYETKAEGKWLVVGWAPQEKVLAHEAVGGFLTHSGWNSILESIAAGVPMISCPKIGDQSSNCTWISKVWKIGLEMEDRYDRVSVETMVRSIMEQEGEKMQKTIAELAKQAKYKVSKDGTSYQNLECLIQDIKKLNQIEGFINNPNFSDLLRV

SEQ ID NO: 121 - protein, 473 aa, Siraitia grosvenorii UGT94-289-2
MDAQQGHTTTILMLPWVGYGHLLPFLELAKSLSRRKLFHIYFCSTSVSLDAIKPKLPPSISSDDSIQLVELRLPSSPELPPHLHTTNGLPSHLMPALHQAFVMAAQHFQVILQTLAPHLLIYDILQPWAPQVASSLNIPAINFSTTGASMLSRTLHPTHYPSSKFPISEFVLHNHWRAMYTTADGALTEEGHKIEETLANCLHTSCGVVLVNSFRELETKYIDYLSVLLNKKVVPVGPLVYEPNQEGEDEGYSSIKNWLDKKEPSSTVFVSFGTEYFPSKEEMEEIAYGLELSEVNFIWVLRFPQGDSTSTIEDALPKGFLERAGERAMVVKGWAPQAKILKHWSTGGLVSHCGWNSMMEGMMFGVPIIAVPMHLDQPFNAGLVEEAGVGVEAKRDSDGKIQREEVAKSIKEVVIEKTREDVRKKAREMDTKHGPTYFSRSKVSSFGRLYKINRPTTLTVGRFWSKQIKMKRE

SEQ ID NO: 122 - protein, 453 aa, Siraitia grosvenorii UGT94-289-1
MDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFNTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKI

SEQ ID NO: 123 - protein, 472 aa, Momordica charantia 1
MAQPQTQARVLVFPYPTVGHIKPFLSLAELLADGGLDVVFLSTEYNHRRIPNLEALASRFPTLHFDTIPDGLPIDKPRVIIGGELYTSMRDGVKQRLRQVLQSYNDGSSPITCVICDVMLSGPIEAAEELGIPVVTFCPYSARYLCAHFVMPKLIEEGQIPFTDGNLAGEIQGVPLFGGLLRRDHLPGFWFVKSLSDEVWSHAFLNQTLAVGRTSALIINTLDELEAPFLAHLSSTFDKIYPIGPLDALSKSRLGDSSSSSTVLTAFWKEDQACMSWLDSQPPKSVIFVSFGSTMRMTADKLVEFWHGLVNSGTRFLCVLRSDIVEGGGAADLIKQVGETGNGIVVEWAAQEKVLAHRAVGGFLTHCGWNSTMESIAAGVPMMCWQIYGDQMINATWIGKVWKIGIERDDKWDRSTVEKMIKELMEGEKGAEIQRSMEKFSKLANDKVVKGGTSFENLELIVEYLKKLKPSN

SEQ ID NO: 124 - protein, 466 aa, Momordica charantia 2
MAQPRVLLFPFPAMGHVKPFLSLAELLSDAGVEVVFLSTEYNHRRIPDIGALAARFPTLHFETIPDGLPPDQPRVLADGHLYFSMLDGTKPRFRQLIQSLNGNPRPITCIINDVMLSSPIEVAEEFGIPVIAFCPCSARFLSVHFFMPNFIEEAQIPYTDENPMGKIEEATVFEGLLRRKDLPGLWCAKSSNISFSHRFINQTIAAGRASALILNTFDELESPFLNHLSSIFPKIYCIGPLNALSRSRLGKSSSSSSALAGFWKEDQAYMSWLESQPPRSVIFVSFGSTMKMEAWKLAEFWYGLVNSGSPFLFVFRPDCVINSGDAAEVMEGRGRGMVVEWASQEKVLAHPAVGGFLTHCGWNSTVESIVAGVPMMCCPIVADQLSNATWIHKVWKIGIEGDEKWDRSTVEMMIKELMESQKGTEIRTSIEMLSKLANEKVVKGGTSLNNFELLVEDIKTLRRPYT

SEQ ID NO: 125 - protein, 482 aa, Momordica charantia 3
MEQSDSNSDDHQHHVLLFPFPAKGHIKPFLCLAQLLCGAGLQVTFLNTDHNHRRIDDRHRRLLATQFPMLHFKSISDGLPPDHPRDLLDGKLIASMRRVTESLFRQLLLSYNGYGNGTNNVSNSGRRPPISCVITDVIFSFPVEVAEELGIPVFSFATFSARFLFLYFWIPKLIQEGQLPFPDGKTNQELYGVPGAEGIIRCKDLPGSWSVEAVAKNDPMNFVKQTLASSRSSGLILNTFEDLEAPFVTHLSNTFDKIYTIGPIHSLLGTSHCGLWKEDYACLAWLDARPRKSVVFVSFGSLVKTTSRELMELWHGLVSSGKSFLLVLRSDVVEGEDEEQVVKEILESNGEGKWLVVGWAPQEEVLAHEAIGGFLTHSGWNSTMESIAAGVPMVCWPKIGDQPSNCTWVSRVWKVGLEMEERYDRSTVARMARSMMEQEGKEMERRIAELAKRVKYRVGKDGESYRNLESLIRDIKITKSSN

SEQ ID NO: 126 - protein, 450 aa, Momordica charantia 4
MDAHQQAEHTTTILMLPWVGYGHLTAYLELAKALSRRNFHIYYCSTPVNIESIKPKLTIPCSSIQFVELHLPSSDDLPPNLHTTNGLPSHLMPTLHQAFSAAAPLFEEILQTLCPHLLIYDSLQPWAPKIASSLKIPALNFNTSGVSVIAQALHAIHHPDSKFPLSDFILHNYWKSTYTTADGGASEKTRRAREAFLYCLNSSGNAILINTFRELEGEYIDYLSLLLNKKVIPIGPLVYEPNQDEDQDEEYRSIKNWLDKKEPCSTVFVSFGSEYFPSNEEMEEIAPGLEESGANFIWVVRFPKLENRNGIIEEGLLERAGERGMVIKEWAPQARILRHGSIGGFVSHCGWNSVMESIICGVPVIGVPMRVDQPYNAGLVEEAGVGVEAKRDPDGKIQRHEVSKLIKQVVVEKTRDDVRKKVAQMSEILRRKGDEKIDEMVALISLLPKG

SEQ ID NO: 127 - protein, 450 aa, Momordica charantia 5
MDARQQAEHTTTILMLPWVGYGHLSAYLELAKALSRRNFHIYYCSTPVNIESIKPKLTIPCSSIQFVELHLPFSDDLPPNLHTTNGLPSHLMPALHQAFSAAAPLFEAILQTLCPHLLIYDSLQPWAPQIASSLKIPALNFNTTGVSVIARALHTIHHPDSKFPLSEIVLHNYWKATHATADGANPEKFRRDLEALLCCLHSSCNAILINTFRELEGEYIDYLSLLLNKKVTPIGPLVYEPNQDEEQDEEYRSIKNWLDKKEPYSTIFVSFGSEYFPSNEEMEEIARGLEESGANFIWVVRFHKLENGNGITEEGLLERAGERGMVIQGWAPQARILRHGSIGGFVSHCGWNSVMESIICGVPVIGVPMGLDQPYNAGLVEEAGVGVEAKRDPDGKIQRHEVSKLIKQVVVEKTRDDVRKKVAQMSEILRRKGDEKIDEMVALISLLLKG

SEQ ID NO: 128 - protein, 471 aa, Cucumis sativus
MGLSPTDHVLLFPFPAKGHIKPFFCLAHLLCNAGLRVTFLSTEHHHQKLHNLTHLAAQIPSLHFQSISDGLSLDHPRNLLDGQLFKSMPQVTKPLFRQLLLSYKDGTSPITCVITDLILRFPMDVAQELDIPVFCFSTFSARFLFLYFSIPKLLEDGQIPYPEGNSNQVLHGIPGAEGLLRCKDLPGYWSVEAVANYNPMNFVNQTIATSKSHGLILNTFDELEVPFITNLSKIYKKVYTIGPIHSLLKKSVQTQYEFWKEDHSCLAWLDSQPPRSVMFVSFGSIVKLKSSQLKEFWNGLVDSGKAFLLVLRSDALVEETGEEDEKQKELVIKEIMETKEEGRWVIVNWAPQEKVLEHKAIGGFLTHSGWNSTLESVAVGVPMVSWPQIGDQPSNATWLSKVWKIGVEMEDSYDRSTVESKVRSIMEHEDKKMENAIVELAKRVDDRVSKEGTSYQNLQRLIEDIEGFKLN

SEQ ID NO: 129 - protein, 462 aa, Cucurbita maxima 1
MELSHTHHVLLFPFPAKGHIKPFFSLAQLLCNAGLRVTFLNTDHHHRRIHDLNRLAAQLPTLHFDSVSDGLPPDEPRNVFDGKLYESIRQVTSSLFRELLVSYNNGTSSGRPPITCVITDVMFRFPIDIAEELGIPVFTFSTFSARFLFLIFWIPKLLEDGQLRYPEQELHGVPGAEGLIRWKDLPGFWSVEDVADWDPMNFVNQTLATSRSSGLILNTFDELEAPFLTSLSKIYKKIYSLGPINSLLKNFQSQPQYNLWKEDHSCMAWLDSQPRKSVVFVSFGSVVKLTSRQLMEFWNGLVNSGMPFLLVLRSDVIEAGEEVVREIMERKAEGRWVIVSWAPQEEVLAHDAVGGFLTHSGWNSTLESLAAGVPMISWPQIGDQTSNSTWISKVWRIGLQLEDGFDSSTIETMVRSIMDQTMEKTVAELAERAKNRASKNGTSYRNFQTLIQDITNIIETHI

SEQ ID NO: 130 - protein, 454 aa, Cucurbita maxima 2
MDAQKAVDTPPTTVLMLPWIGYGHLSAYLELAKALSRRNFHVYFCSTPVNLDSIKPNLIPPPSSIQFVDLHLPSSPELPPHLHTTNGLPSHLKPTLHQAFSAAAQHFEAILQTLSPHLLIYDSLQPWAPRIASSLNIPAINFNTTAVSIIAHALHSVHYPDSKFPFSDFVLHDYWKAKYTTADGATSEKIRRGAEAFLYCLNASCDVVLVNSFRELEGEYMDYLSVLLKKKVVSVGPLVYEPSEGEEDEEYWRIKKWLDEKEALSTVLVSFGSEYFPSKEEMEEIAHGLEESEANFIWVVRFPKGEESCRGIEEALPKGFVERAGERAMVVKKWAPQGKILKHGSIGGFVSHCGWNSVLESIRFGVPVIGVPMHLDQPYNAGLLEEAGIGVEAKRDADGKIQRDQVASLIKRVVVEKTREDIWKTVREMREVLRRRDDDMIDEMVAEISVVLKI

SEQ ID NO: 131 - protein, 492 aa, Cucurbita maxima 3
MSSNLFLKISIPFGRLRDSALNCSVFHCKLHLAIAIAMDAQQAANKSPTATTIFMLPWAGYGHLSAYLELAKALSTRNFHIYFCSTPVSLASIKPRLIPSCSSIQFVELHLPSSDEFPPHLHTTNGLPSRLVPTFHQAFSEAAQTFEAFLQTLRPHLLIYDSLQPWAPRIASSLNIPAINFFTAGAFAVSHVLRAFHYPDSQFPSSDFVLHSRWKIKNTTAESPTQAKLPKIGEAIGYCLNASRGVILTNSFRELEGKYIDYLSVILKKRVFPIGPLVYQPNQDEEDEDYSRIKNWLDRKEASSTVLVSFGSEFFLSKEETEAIAHGLEQSEANFIWGIRFPKGAKKNAIEEALPEGFLERAGGRAMVVEEWVPQGKILKHGSIGGFVSHCGWNSAMESIVCGVPIIGIPMQVDQPFNAGILEEAGVGVEAKRDSDGKIQRDEVAKLIKEVVVERTREDIRNKLEKINEILRSRREEKLDELATEISLLSRN

SEQ ID NO: 132 - protein, 462 aa, Cucurbita moschata 1
MELSPTHHLLLFPFPAKGHIKPFFSLAQLLCNAGARVTFLNTDHHHRRIHDLDRLAAQLPTLHFDSVSDGLPPDESRNVFDGKLYESIRQVTSSLFRELLVSYNNGTSSGRPPITCVITDCMFRFPIDIAEELGIPVFTFSTFSARFLFLFFWIPKLLEDGQLRYPEQELHGVPGAEGLIRCKDLPGFLSDEDVAHWKPINFVNQILATSRSSGLILNTFDELEAPFLTSLSKIYKKIYSLGPINSLLKNFQSQPQYNLWKEDHSCMAWLDSQPPKSVVFVSFGSVVKLTNRQLVEFWNGLVNSGKPFLLVLRSDVIEAGEEVVRENMERKAEGRWMIVSWAPQEEVLAHDAVGGFLTHSGWNSTLESLAAGVPMISWTQIGDQTSNSTWVSKVWRIGLQLEDGFDSFTIETMVRSVMDQTMEKTVAELAERAKNRASKNGTSYRNFQTLIQDITNIIETHI

SEQ ID NO: 133 - protein, 457 aa, Cucurbita moschata 2
MDAQKAVDTPPTTVLMLPWIGYGHLSAYLELAKALSRRNFHVYFCSTPVNLDSIKPNLIPPPPSIQFVDLHLPSSPELPPHLHTTNGLPSHLKPTLHQAFSAAAQHFEAILQTLSPHLLIYDSLQPWAPRIASSLNIPAINFNTTAVSIIAHALHSVHYPDSKFPFSDFVLHDYWKAKYTTADGATSEKTRRGVEAFLYCLNASCDVVLVNSFRELEGEYMDYLSVLLKKKVVSVGPLVYEPSEGEEDEEYWRIKKWLDEKEALSTVLVSFGSEYFPPKEEMEEIAHGLEESEANFIWVVRFPKGEESSSRGIEEALPKGFVERAGERAMVVKKWAPQGKILKHGSIGGFVSHCGWNSVLESIRFGVPVIGAPMHLDQPYNAGLLEEAGIGVEAKRDADGKIQRDQVASLIKQVVVEKTREDIWKKVREMREVLRRRDDDDMMIDEMVAVISVVLKI

SEQ ID NO: 134 - protein, 455 aa, Cucurbita moschata 3
MDAQQAANKSPTASTIFMLPWVGYGHLSAYLELAKALSTRNFHVYFCSTPVSLASIKPRLIPSCSSIQFVELHLPSSDEFPPHLHTTNGLPAHLVPTIHQAFAAAAQTFEAFLQTLRPHLLIYDSLQPWAPRIASSLNIPAINFFTAGAFAVSHVLRAFHYPDSQFPSSDFVLHSRWKIKNTTAESPTQVKIPKIGEAIGYCLNASRGVILTNSFRELEGKYIDYLSVILKKRVLPIGPLVYQPNQDEEDEDYSRIKNWLDRKEASSTVLVSFGSEFFLSKEETEAIAHGLEQSEANFIWGIRFPKGAKKNAIEEALPEGFLERVGGRAMVVEEWVPQGKILKHGNIGGFVSHCGWNSAMESIMCGVPVIGIPMQVDQPFNAGILEEAGVGVEAKRDSDGKIQRDEVAKLIKEVVVERTREDIRNKLEEINEILRTRREEKLDELATEISLLCKN

SEQ ID NO: 135 - protein, 474 aa, Prunus persica
MAMKQPHVIIFPFPLQGHMKPLLCLAELLCHAGLHVTYVNTHHNHQRLANRQALSTHFPTLHFESISDGLPEDDPRTLNSQLLIALKTSIRPHFRELLKTISLKAESNDTLVPPPSCIMTDGLVTFAFDVAEELGLPILSFNVPCPRYLWTCLCLPKLIENGQLPFQDDDMNVEITGVPGMEGLLHRQDLPGFCRVKQADHPSLQFAINETQTLKRASALILDTVYELDAPCISHMALMFPKIYTLGPLHALLNSQIGDMSRGLASHGSLWKSDLNCMTWLDSQPSKSIIYVSFGTLVHLTRAQVIEFWYGLVNSGHPFLWVMRSDITSGDHQIPAELENGTKERGCIVDWVSQEEVLAHKSVGGFLTHSGWNSTLESIVAGLPMICWPKLGDHYIISSTVCRQWKIGLQLNENCDRSNIESMVQTLMGSKREEIQSSMDAISKLSRDSVAEGGSSHNNLEQLIEYIRNLQHQN

SEQ ID NO: 136 - protein, 468 aa, Theobroma cacao
MRQPHVLVLPFPAQGHIKPMLCLAELLCQAGLRVTFLNTHHSHRRLNNLQDLSTRFPTLHFESVSDGLPEDHPRNLVHFMHLVHSIKNVTKPLLRDLLTSLSLKTDIPPVSCIIADGILSFAIDVAEELQIKVIIFRTISSCCLWSYLCVPKLIQQGELQFSDSDMGQKVSSVPEMKGSLRLHDRPYSFGLKQLEDPNFQFFVSETQAMTRASAVIFNTFDSLEAPVLSQMIPLLPKVYTIGPLHALRKARLGDLSQHSSFNGNLREADHNCITWLDSQPLRSVVYVSFGSHVVLTSEELLEFWHGLVNSGKRFLWVLRPDIIAGEKDHNQIIAREPDLGTKEKGLLVDWAPQEEVLAHPSVGGFLTHCGWNSTLESMVAGVPMLCWPKLPDQLVNSSCVSEVWKIGLDLKDMCDRSTVEKMVRALMEDRREEVMRSVDGISKLARESVSHGGSSSSNLEMLIQELET

SEQ ID NO: 137 - protein, 462 aa, Corchorus capsularis
MDSKQKKMSVLMFPWLAYGHISPFLELAKKLSKRNFHTFFFSTPINLNSIKSKLSPKYAQSIQFVELHLPSLPDLPPHYHTTNGLPPHLMNTLKKAFDMSSLQFSKILKTLNPDLLVYDFIQPWAPLLALSNKIPAVHFLCTSAAMSSFSVHAFKKPCEDFPFPNIYVHGNFMNAKFNNMENCSSDDSISDQDRVLQCFERSTKIILVKTFEELEGKFMDYLSVLLNKKIVPTGPLTQDPNEDEGDDDERTKLLLEWLNKKSKSSTVFVSFGSEYFLSKEEREEIAYGLELSKVNFIWVIRFPLGENKTNLEEALPQGFLQRVSERGLVVENWAPQAKILQHSSIGGFVSHCGWSSVMESLKFGVPIIAIPMHLDQPLNARLVVDVGVGLEVIRNHGSLEREEIAKLIKEVVLGNGNDGEIVRRKAREMSNHIKKKGEKDMDELVEELMLICKMKPNSCHLS

SEQ ID NO: 138 - protein, 448 aa, Ziziphus jujube
MMERQRSIKVLMFPWLAHGHISPFLELAKRLTDRNFQIYFCSTPVNLTSVKPKLSQKYSSSIKLVELHLPSLPDLPPHYHTTNGLALNLIPTLKKAFDMSSSSFSTILSTIKPDLLIYDFLQPWAPQLASCMNIPAVNFLSAGASMVSFVLHSIKYNGDDHDDEFLTTELHLSDSMEAKFAEMTESSPDEHIDRAVTCLERSNSLILIKSFRELEGKYLDYLSLSFAKKVVPIGPLVAQDTNPEDDSMDIINWLDKKEKSSTVFVSFGSEYYLTNEEMEEIAYGLELSKVNFIWVVRFPLGQKMAVEEALPKGFLERVGEKGMVVEDWAPQMKILGHSSIGGFVSHCGWSSLMESLKLGVPIIAMPMQLDQPINAKLVERSGVGLEVKRDKNGRIEREYLAKVIREIVVEKARQDIEKKAREMSNIITEKGEEEIDNVVEELAKLCGM

SEQ ID NO: 139 - protein, 446 aa, Vitis vinifera
MDARQSDGISVLMFPWLAHGHISPFLQLAKKLSKRNFSIYFCSTPVNLDPIKGKLSESYSLSIQLVKLHLPSLPELPPQYHTTNGLPPHLMPTLKMAFDMASPNFSNILKTLHPDLLIYDFLQPWAPAAASSLNIPAVQFLSTGATLQSFLAHRHRKPGIEFPFQEIHLPDYEIGRLNRFLEPSAGRISDRDRANQCLERSSRFSLIKTFREIEAKYLDYVSDLTKKKMVTVGPLLQDPEDEDEATDIVEWLNKKCEASAVFVSFGSEYFVSKEEMEEIAHGLELSNVDFIWVVRFPMGEKIRLEDALPPGFLHRLGDRGMVVEGWAPQRKILGHSSIGGFVSHCGWSSVMEGMKFGVPIIAMPMHLDQPINAKLVEAVGVGREVKRDENRKLEREEIAKVIKEVVGEKNGENVRRKARELSETLRKKGDEEIDVVVEELKQLCSY

SEQ ID NO: 140 - protein, 456 aa, Juglans regia
MDTARKRIRVVMLPWLAHGHISPFLELSKKLAKRNFHIYFCSTPVNLSSIKPKLSGKYSRSIQLVELHLPSLPELPPQYHTTKGLPPHLNATLKRAFDMAGPHFSNILKTLSPDLLIYDFLQPWAPAIAASQNIPAINFLSTGAAMTSFVLHAMKKPGDEFPFPEIHLDECMKTRFVDLPEDHSPSDDHNHISDKDRALKCFERSSGFVMMKTFEELEGKYINFLSHLMQKKIVPVGPLVQNPVRGDHEKAKTLEWLDKRKQSSAVFVSFGTEYFLSKEEMEEIAYGLELSNVNFIWVVRFPEGEKVKLEEALPEGFLQRVGEKGMVVEGWAPQAKILMHPSIGGFVSHCGWSSVMESIDFGVPIVAIPMQLDQPVNAKVVEQAGVGVEVKRDRDGKLEREEVATVIREVVMGNIGESVRKKEREMRDNIRKKGEEKMDGVAQELVQLYGNGIKNV

SEQ ID NO: 141 - protein, 456 aa, Hevea brasiliensis
METLQRRKISVLMFPWLAHGHLSPFLELSKKLNKRNFHVYFCSTPVNLDSIKPKLSAEYSFSIQLVELHLPSSPELPLHYHTTNGLPPHLMKNLKNAFDMASSSFFNILKTLKPDLLIYDFIQPWAPALASSLNIPAVNFLCTSMAMSCFGLHLNNQEAKFPFPGIYPRDYMRMKVFGALESSSNDIKDGERAGRCMDQSFHLILAKTFRELEGKYIDYLSVKLMKKIVPVGPLVQDPIFEDDEKIMDHHQVIKWLEKKERLSTVFVSFGTEYFLSTEEMEEIAYGLELSKAHFIWVVRFPTGEKINLEESLPKRYLERVQERGKIVEGWAPQQKILRHSSIGGFVSHCGWSSIMESMKFGVPIIAMPMNLDQPVNSRIVEDAGVGIEVRRNKSGELEREEIAKTIRKVVVEKDGKNVSRKAREMSDTIRKKGEEEIDGVVDELLQLCDVKTNYLQ

SEQ ID NO: 142 - protein, 461 aa, Manihot esculenta
MATAQTRKISVLMFPWLAHGHLSPFLELSKKLANRNFHVYFCSTPVNLDSIKPKLSPEYHFSIQFVELHLPSSPELPSHYHTTNGLPPHLMKTLKKAFDMASSSFFNILKTLNPDLLIYDFLQPWAPALASSLNIPAVNFLCSSMAMSCFGLNLNKNKEIKFLFPEIYPRDYMEMKLFRVFESSSNQIKDGERAGRCIDQSFHVILAKTFRELEGKYIDYVSVKCNKKIVPVGPLVEDTIHEDDEKTMDHHHHHHDEVIKWLEKKERSTTVFVSFGSEYFLSKEEMEEIAHGLELSKVNFIWVVRFPKGEKINLEESLPEGYLERIQERGKIVEGWAPQRKILGHSSIGGFVSHCGWSSIMESMKLGVPIIAMPMNLDQPINSRIVEAAGVGIEVSRNQSGELEREEMAKTIRKVVVEREGVYVRRKAREMSDVLRKKGEEEIDGVVDELVQLCDMKTNYL

SEQ ID NO: 143 - protein, 452 aa, Cephalotus follicularis
MDLKRRSIRVLMLPWLAHGHISPFLELAKKLTNRNFLIYFCSTPINLNSIKPKLSSKYSFSIQLVELHLPSLPELPPHYHTTNGLPLHLMNTLKTAFDMASPSFLNILKTLKPDLLICDHLQPWAPSLASSLNIPAIIFPTNSAIMMAFSLHHAKNPGEEFPFPSININDDMVKSINFLHSASNGLTDMDRVLQCLERSSNTMLLKTFRQLEAKYVDYSSALLKKKIVLAGPLVQVPDNEDEKIEIIKWLDSRGQSSTVFVSFGSEYFLSKEEREDIAHGLELSKVNFIWVVRFPVGEKVKLEEALPNGFAERIGERGLVVEGWAPQAMILSHSSIGGFVSHCGWSSMMESMKFGVPIIAMPMHIDQPLNARLVEDVGVGLEIKRNKDGRFEREELARVIKEVLVYKNGDAVRSKAREMSEHIKKNGDQEIDGVADALVKLCEMKTNSLNQD

SEQ ID NO: 144 - protein, 460 aa, Stevia rebaudiana
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 145 - protein, 458 aa, Stevia rebaudiana
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 146 - protein, 481 aa, Stevia rebaudiana
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 147 - protein, 485 aa, Stevia rebaudiana
MYNVTYHQNSKAMATSDSIVDDRKQLHVATFPWLAFGHILPFLQLSKLIAEKGHKVSFLSTTRNIQRLSSHISPLINVVQLTLPRVQELPEDAEATTDVHPEDIQYLKKAVDGLQPEVTRFLEQHSPDWIIYDFTHYWLPSIAASLGISRAYFCVITPWTIAYLAPSSDAMINDSDGRTTVEDLTTPPKWFPFPTKVCWRKHDLARMEPYEAPGISDGYRMGMVFKGSDCLLFKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFCDQPLNARLLEDKQVGIEIPRNEEDGCLTKESVARSLRSVVVENEGEIYKANARALSKIYNDTKVEKEYVSQFVDYLEKNARAVAIDHES

SEQ ID NO: 148 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEVPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNTRAVAIDHES

SEQ ID NO: 149 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 150 - protein, 462 aa, OsUGT1-2
MDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVARNDGDGSFDREGVAAAIRAVAVEEESSKVFQAKAKKLQEIVADMACHERYIDGFIQQLRSYKD

SEQ ID NO: 151 - protein, 490 aa, Arabidopsis thaliana
MGSISEMVFETCPSPNPIHVMLVSFQGQGHVNPLLRLGKLIASKGLLVTFVTTELWGKKMRQANKIVDGELKPVGSGSIRFEFFDEEWAEDDDRRADFSLYIAHLESVGIREVSKLVRRYEEANEPVSCLINNPFIPWVCHVAEEFNIPCAVLWVQSCACFSAYYHYQDGSVSFPTETEPELDVKLPCVPVLKNDEIPSFLHPSSRFTGFRQAILGQFKNLSKSFCVLIDSFDSLEREVIDYMSSLCPVKTVGPLFKVARTVTSDVSGDICKSTDKCLEWLDSRPKSSVVYISFGTVAYLKQEQIEEIAHGVLKSGLSFLWVIRPPPHDLKVETHVLPQELKESSAKGKGMIVDWCPQEQVLSHPSVACFVTHCGWNSTMESLSSGVPVVCCPQWGDQVTDAVYLIDVFKTGVRLGRGATEERVVPREEVAEKLLEATVGEKAEELRKNALKWKAEAEAAVAPGGSSDKNFREFVEKLGAGVTKTKDNGY

SEQ ID NO: 152 - protein, 481 aa, Arabidopsis thaliana
MGSHVAQKQHVVCVPYPAQGHINPMMKVAKLLYAKGFHITFVNTVYNHNRLLRSRGPNAVDGLPSFRFESIPDGLPETDVDVTQDIPTLCESTMKHCLAPFKELLRQINARDDVPPVSCIVSDGCMSFTLDAAEELGVPEVLFWTTSACGFLAYLYYYRFIEKGLSPIKDESYLTKEHLDTKIDWIPSMKNLRLKDIPSFIRTTNPDDIMLNFIIREADRAKRASAIILNTFDDLEHDVIQSMKSIVPPVYSIGPLHLLEKQESGEYSEIGRTGSNLWREETECLDWLNTKARNSVVYVNFGSITVLSAKQLVEFAWGLAATGKEFLWVIRPDLVAGDEAMVPPEFLTATADRRMLASWCPQEKVLSHPAIGGFLTHCGWNSTLESLCGGVPMVCWPFFAEQQTNCKFSRDEWEVGIEIGGDVKREEVEAVVRELMDEEKGKNMREKAEEWRRLANEATEHKHGSSKLNFEMLVNKVLLGE

SEQ ID NO: 153 - protein, 438 aa, Columba livia
MIHCGKKHICAFVTCILISASILMYSWKDPQLQNNITRKIFQATSALPASQLCRGKPAQNVITALEDNRTFIISPYFDDRESKVTRVIGIVHHEDVKQLYCWFCCQPDGKIYVARAKIDVHSDRFGFPYGAADIVCLEPENCNPTHVSIHQSPHANIDQLPSFKIKNRKSETFSVDFTVCISAMFGNYNNVLQFIQSVEMYKILGVQKVVIYKNNCSQLMEKVLKFYMEEGTVEIIPWPINSHLKVSTKWHFSMDAKDIGYYGQITALNDCIYRNMQRSKFVVLNDADEIILPLKHLDWKAMMSSLQEQNPGAGIFLFENHIFPKTVSTPVFNISSWNRVPGVNILQHVHREPDRKEVFNPKKMIIDPRQVVQTSVHSVLRAYGNSVNVPADVALVYHCRVPLQEELPRESLIRDTALWRYNSSLITNVNKVLHQTVL

SEQ ID NO: 154 - protein, 252 aa, Haemophilus ducreyi
MPTLTVAMIVKNEAQDLAECLKTVDGWVDEIVIVDSGSTDDTLKIATQFNAKVYVNSDWQGFGPQRQFAQQYVTSDYVLWLDADERVTPELKASILQAVQHNQKNTVYKVSRLSEIFGKEIRYSGWYPDYVVRLYPTYLAKYGDELVHEKVHYPADSRVEKLQGDLLHFTYKNIHHYLVKSASYAKAWAMQRAKAGKKASLLDGVTHAIACFLKMYLFKAGFLDGKQGFLLAVLSAHSTFVKYADLWDRTRS

SEQ ID NO: 155 - protein, 252 aa, Neisseria gonorrhoeae
MKKVSVLIVAKNEANHIRECIESCRFDKEVIVIDDHSADNTAEIAEGLGAKVFRRHLNGDFGAQKTFAIEQAGGEWVFLIDADERCTPELSDEISKIVRTGDYAAYFVERRNLFPNHPATHGAMRPDSVCRLMPKKGGSVQGKVHETVQTPYPERRLKHFMYHYTYDNWEQYFNKFNKYTSISAEKYREQGKPVSFVRDIILRPIWGFFKIYILNKGFLDGKMGWIMSVNHSYYTMIKYVKLYYLYKSGGKF

SEQ ID NO: 156 - protein, 309 aa, Rhizobium meliloti
MPNETLHIDIGVCTYRRPELAETLRSLAAMNVPERARLRVIVADNDAEPSARALVEGLRPEMPFDILYVHCPHSNISIARNCCLDNSTGDFLAFLDDDETVSGDWLTRLLETARTTGAAAVLGPVRAHYGPTAPRWMRSGDFHSTLPVWAKGEIRTGYTCNALLRRDAASLLGRRFKLSLGKSGGEDTDFFTGMHCAGGTIAFSPEAWVHEPVPENRASLAWLAKRRFRSGQTHGRLLAEKAHGLRQAWNIALAGAKSGFCATAAVLCFPSAARRNRFALRAVLHAGVISGLLGLKEIEQYGAREVTSA

SEQ ID NO: 157 - protein, 861 aa, Rhizobium radiobacter
MCRCGRAVRSRPVCRPGQLVVRRSPRPRSRNHSRCRPLRLSVFPRPHRRVRHHCQRDLRWEPGRWIAVRWKAARSHRRFRRCPFPRQLVWPVRERHRDAGDRRNQRERRRRDAYHEISEPKFRTRKRTESFWMNKAITVIVWLLVSLCVLAIITMPVSLQTHLVATAISLILLATIKSFNGQGAWRLVALGFGTAIVLRYVYWRTTSTLPPVNQLENFIPGFLLYLAEMYSVVMLGLSLVIVSMPLPSRKTRPGSPDYRPTVDVFVPSYNEDAELLANTLAAAKNMDYPADRFTVWLLDDGGSVQKRNAANIVEAQAAQRRHEELKKLCEDLDVRYLTRERNVHAKAGNLNNGLAHSTGELVTVFDADHAPARDFLLETVGYFDEDPRLFLVQTPHFFVNPDPIERNLRTFETMPSENEMFYGIIQRGLDKWNGAFFCGSAAVLRREALQDSDGFSGVSITEDCETALALHSRGWNSVYVDKPLIAGLQPATFASFIGQRSRWAQGMMQILIFRQPLFKRGLSFTQRLCYMSSTLFWLFPFPRTIFLFAPLFYLFFDLQIFVASGGEFLAYTAAYMLVNLMMQNYLYGSFRWPWISELYEYVQTVHLLPAVVSVIFNPGKPTFKVTAKDESIAEARLSEISRPFFVIFALLLVAMAFAVWRIYSEPYKADVTLVVGGWNLLNLIFAGCALGVVSERGDKSASRRITVKRRCEVQLGGSDTWVPASIDNVSVHGLLINIFDSATNIEKGATAIVKVKPHSEGVPETMPLNVVRTVRGEGFVSIGCTFSPQRAVDHRLIADLIFANSEQWSEFQRVRRKKPGLIRGTAIFLAIALFQTQRGLYYLVRARRPAPKSAKPVGAVK

SEQ ID NO: 158 - protein, 315 aa, Streptococcus agalactiae
MIKKIEKDLISVIVPIYNVEDYLVECIESLIVQTYRNIEILLINDGSTDNCATIAKEFSERDCRVIYIEKSNGGLSEARNYGIYHSKGKYLTFVDSDDKVSSDYIANLYNAIQKHDSSIAIGGYLEFYERHNSIRNYEYLDKVIPVEEALLNMYDIKTYGSIFITAWGKLFHKSIFNDLEFALNKYHEDEFFNYKAYLKANSITYIDKPLYHYRIRVGSIMNNSDNVIIARKKLDVLSALDERIKLITSLRKYSVFLQKTEIFYVNQYFRTKKFLKQQSVMFKEDNYIDAYRMYGRLLRKVKLVDKLKLIKNRFF

SEQ ID NO: 159 - protein, 416 aa, Streptococcus pneumoniae
MYTFILMLLDFFQNHDFHFFMLFFVFILIRWAVIYFHAVRYKSYSCSVSDEKLFSSVIIPVVDEPLNLFESVLNRISRHKPSEIIVVINGPKNERLVKLCHDFNEKLENNMTPIQCYYTPVPGKRNAIRVGLEHVDSQSDITVLVDSDTVWTPRTLSELLKPFVCDKKIGGVTTRQKILDPERNLVTMFANLLEEIRAEGTMKAMSVTGKVGCLPGRTIAFRNIVERVYTKFIEETFMGFHKEVSDDRSLTNLTLKKGYKTVMQDTSVVYTDAPTSWKKFIRQQLRWAEGSQYNNLKMTPWMIRNAPLMFFIYFTDMILPMLLISFGVNIFLLKILNITTIVYTASWWEIILYVLLGMIFSFGGRNFKAMSRMKWYYVFLIPVFIIVLSIIMCPIRLLGLMRCSDDLGWGTRNLTE

SEQ ID NO: 160 - protein, 482 aa, MbUGTc13
MADAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEATQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 161 - protein, 463 aa, MbUGTc19
MANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKAGSGEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKA

SEQ ID NO: 162 - protein, 458 aa, MbUGT1-3; identical to SEQ ID NO: 145

SEQ ID NO: 163 - protein, 463 aa, MbUGT1-2
MATKGSSGMSLAERFWLTLSRSSLVVGRSCVEFEPETVPLLSTLRGKPITFLGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVARNDGDGSFDREGVAAAIRAVAVEEESSKVFQAKAKKLQEIVADMACHERYIDGFIQQLRSYKDDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWAAAAALEHKVPCAMMLLGSAEMIASIADERLEHAETESPAAAGQGRPAAAPTFEVARMKLIR

SEQ ID NO: 164 - protein, 452 aa, Coffea arabica
MAENHATFNVLMLPWLAHGHVSPYLELAKKLTARNFNVYLCSSPATLSSVRSKLTEKFSQSIHLVELHLPKLPELPAEYHTTNGLPPHLMPTLKDAFDMAKPNFCNVLKSLKPDLLIYDLLQPWAPEAASAFNIPAVVFISSSATMTSFGLHFFKNPGTKYPYGNAIFYRDYESVFVENLTRRDRDTYRVINCMERSSKIILIKGFNEIEGKYFDYFSCLTGKKVVPVGPLVQDPVLDDEDCRIMQWLNKKEKGSTVFVSFGSEYFLSKKDMEEIAHGLEVSNVDFIWVVRFPKGENIVIEETLPKGFFERVGERGLVVNGWAPQAKILTHPNVGGFVSHCGWNSVMESMKFGLPIIAMPMHLDQPINARLIEEVGAGVEVLRDSKGKLHRERMAETINKVMKEASGESVRKKARELQEKLELKGDEEIDDVVKELVQLCATKNKRNGLHYY

SEQ ID NO: 165 - protein, 484 aa, Stevia rebaudiana
MADQMAKIDEKKPHVVFIPFPAQSHIKCMLKLARILHQKGLYITFINTDTNHERLVASGGTQWLENAPGFWFKTVPDGFGSAKDDGVKPTDALRELMDYLKTNFFDLFLDLVLKLEVPATCIICDGCMTFANTIRAAEKLNIPVILFWTMAACGFMAFYQAKVLKEKEIVPVKDETYLTNGYLDMEIDWIPGMKRIRLRDLPEFILATKQNYFAFEFLFETAQLADKVSHMIIHTFEELEASLVSEIKSIFPNVYTIGPLQLLLNKITQKETNNDSYSLWKEEPECVEWLNSKEPNSVVYVNFGSLAVMSLQDLVEFGWGLVNSNHYFLWIIRANLIDGKPAVMPQELKEAMNEKGFVGSWCSQEEVLNHPAVGGFLTHCGWGSIIESLSAGVPMLGWPSIGDQRANCRQMCKEWEVGMEIGKNVKRDEVEKLVRMLMEGLEGERMRKKALEWKKSATLATCCNGSSSLDVEKLANEIKKLSRN

SEQ ID NO: 166 - protein, 384 aa, Flavobacteriales bacterium
MLNNSLFSRLEEIPALLKLKLGSKDYYKNNNSETLTCDNLRYCFDTLNKVSRSFATVIKQLPNELGNNVCVFYLILRALDSIEDDMNLPKELKIKLLREFHKKNYESGWNISGVGDKKEHVELLENYDKVIQSFLAIDQKNQLIITDICRKVGAGMANFVKAEIESVEDYNLYCHHVAGLVGIGLSRMFISSGLENDDFLNQDEISNSMGLFLQKTNIVRDYREDLDEGRMFWPKDIWHVYGSKINDFAINPTHDQSVLCLNHMLNNALTHATDCLAYLKHLRNENIFKFCAIPQVMAMATLCKIYSNPDVFIKNVKIRKGLAAKLILNTTSMDEVIKVYKDMLLVIESKISSDNNPVSAETIQLLKQIREYFNDETLIVRKIA

SEQ ID NO: 167 - protein, 383 aa, Bacteroidetes bacterium
MLNSSLFSRLEEIPALLKLKLGSINNYKNNNSENLTSKNLRYCFDTLNKVSRSFASVIKQLPNELMVNVCLFYLILRALDSIEDDMNLPKDFKINLLREFLDKNYEPGWKISGVGDKKEYVELLENYDKVIQVFLDIDPKNQLIITDICRKMGAGMAHFVEAEINSVKDYNLYCYHVAGLVGIGLSKMFLASGLENCDYLNQEEISSSMGLFLQKTNIVRDYKEDMEENRIFWPKEIWRTYASKFSDFSINPQHETSISCLNHMVNDALGHVIDCLEYLRHLRNENIFKFCAIPQVMAMATLCKVYNNPDVFIKTVKIRKGLAAKLILNTTSMDEVIKVYKGLLLDIENKIPLHNPTSDETLRLIKNIRSYCNNETMVVSKTA

SEQ ID NO: 168 - protein, 458 aa, Bathymodiolus azoricus Endosymbiont
MHTTSEHNDLFDICIVGAGMAGATIATYLAPRGIKIALIDRDYAEKRRIVGELLQPGAVQTLKKMGLEHLLEGFDAQPIYGYALFNKDCEFSIEYNQDKSTNYRGVGLHNGRFLQKIREDALKQPSITQIHGTVSELIEDENHVVTGVKYKEKYTRELKTVNAKLTITSDGFFSSFRKDLTNNVKTVTSFFVGIILKDCELPYPHHGHVFLSAPTPFICYPISSTESRLLIDFPGDQAPKKEAVKHHIENNVIPFLPKEFRLCLDQALRENDYKIMPNHYMPAKPVLKKGVVLLGDALNMRHPITGGGLTAVFNDVYLLSTHLLAMPDFNDTKLIHEKVNLYYNDRYHANTNVNIMANALYGVMSNDLLKQSVFEYLRKGGDNSGGPISLLAGLNRNPTILIKHFFSVALLCLRNLFKAHKMSLTNAFYVIKDAFCIIVPLAINELRPSSFLKKNIHN

SEQ ID NO: 169 - protein, 458 aa, Methyloprofundus sediment
MNTSPEHNDLFDICIVGVGMAGATIAAYLAPRGLKIALIDREYTEKRRIVGELLQPGAVQTLKKMGLEHLLEGFDAQPIYGYALFNNDKEFSISYNSDDSTEYHGVGLHNGRFLQKIREDVFKNETVTQIHGTVSELIEDKKGVVKGVTYREKHTREYKTVKAKLTVTSDGFFSNFRKDLSNNVKTVTSFFIGLVLNDCNLPFPNHGHVFLSAPTPFICYPISSTETRLLIDYPGDKAPKKDEIREHILNKVAPFLPEEFKECFANAMEDDDFKVMPNHYMPAKPVLKEGAVLLGDALNMRHPLTGGGLTAVFNDVYLLSTHLLAMPDFNDPKLLHEKLELYYQDRYHANTNVNIMANALYGVMSNDLLKQGVFEYLRKGGDNSGGPITLLAGLNRNPTLLIKHFFSVAFLCICNLSGNNKMNFTNVFRVMKDAFCIIKPLAVNELRPSSFYKKNIQL

SEQ ID NO: 170 - protein, 448 aa, Methylomicrobium buryatense
MESNFDICIIGAGMAGATIAAYLAPKGINIALIDHCYKEKKRIVGELLQPGAVLSLEQLGLGHLLDGIDAQPVEGYALLQGNEQTTIPYPSPNHGMGLHNGRFLQQIRASALQNSSVTQIQGKALSLLENEQNEIIGVNYRDSVSNEIKSIYAPLTITSDGFFSNFRELLSNNEKTVTSYFIGLILKDCEIPVPKHGHVFLSGPTPFICYPISSNEVRLLIDFPGGQFPRKAFLQAHLETNVTPYIPEGMQTSYRHALQEDRLKVMPNHYMAAKPKIRKGAVMLGDALNMRHPLTGGGLTAVFSDIEILSGHLLAMPDFNNNDLIYQKIEAYYRDRQYANANLNILANALYGVMSNELLKNSVFKYLQRGGVNAKESIAILAGLNKNHYSLMKQFFFVALFGAYTLVRENITNLPKATKILSDALTIIKPLAKNELSLVGIFSDYFKR

SEQ ID NO: 171 - protein, 474 aa, Cucurbita pepo subsp. pepo
MWAIVVGLATLAVAYYIHWINKWKDSKFNGVLPPGTMGLPLVGETLQLARPSDSLDVHPFIKKKVKRYGPIFKTCLAGRPVVVSTDAEFNNYIMLQEGRAVEMWYLDTLSKFFGLDTEWLKALGFIHKYIRSITLNHFGAESLRERFLPRIEESAKETLRYWATQPSVEVKDSAAVMVFRTSMVKMVSEDSSKLLTGGLTKKFTGLLGGFLTLPINVPGTTYNKCMKDMKEIQKKLREILEGRLASGGGSDEDFLGQAIKDKGSQQFISDDFIIQLLFSISFASFESISTTLTLVLNYLADHPDVVKELEAEHEAIRNARADPDGPITWEEYKSMTFTLHVIFETLRLGSVTPALLRKTTKELQINGYTIPEGWTVMLVTASRHRDPAVYKDPHTFNPWRWKELDSITIQKNFMPFGGGLRHCAGAEYSKVYLCTFLHILFTKYRWTKLKGGKVARAHILSFEDGLHVKFTPKE

SEQ ID NO: 172 - protein, 512 aa, Capsella rubella
MATLMTIDLQNCFIFIILSLLCYYLLFKKQKGSRAGCVLPPSPPSLPIIGHLHLLLSNLTHKSLQNISTKFGSFLYLRVVNLPIVLVSSPSVAYEIYKTHDVNVSSRVATSLGDSLFLGSSGFITAPYGDYWKFMKKMVATKLLRPQAIEQSRGGRAEELQMFYENLLDKAMKKESIEVSKEAMKLTNNIICRMSMGRSCSDENGEAERVRELLVKSTALTKKIFFANMFPRIPLFKKEIMGVSSEFDDLLERLLVEHEERVEEHENKDMMDLLLEAYRDENAEYKISRKQIKSLFVEIFLGGTDTSAQTVQWILAELINKPNILERIREEIDSVVGKSRLMKETDLPNLPYLQATVKEGLRMHPPSPLLVRTFQESCEVKGFYMPEKTMLVINVYALMRDPDTWEDPNEFKPERFLLSSRSRQEDEKEQGMMKYLPFGAGRRGCPGSNLAYLFVGIAVGVMVQCFDWKIKEDKVNMEETTAGMNLAMAHPFKCTPVVRNDPLTLNLENPSS

SEQ ID NO: 173 - protein, 498 aa, Brassica rapa
MIVDFQNCSIFILLCFFTFLCYSVFFFFKKTNDLGPSPPSLPIIGHLHHFLSGLPHKAFQKISTKYGPLLHLHIFSFPIVLVSSPTMAHEIFTTHDLNISSRNTPAIDESLLFGPSGFTVAPYGDYVKFIKKLLATKLLRPRAIEKSRGVRAEELKQFYLKVQDKALKKESIEIGKETMKFTNNMICRMSIGRSFSEENGEVETLRELIIKSFALSKQILFVNVLRRPLEMLGLMSLFKKDIMDVSRGFDELLERVLAEHEEKREEDQDMDMMDLLLEACRDENAEYKITRNQIKSLFVEIFLGGTDTSAHTTQWTMAELVNNPNILGRLRDEIDLVVGKERLIQETDLPNLPYLQAVVKEGLRLHPPAPLLVRMFDKKCVIKDFFKVPEKTTLVVNVYGVMRDPDSWEDPNEFKPERFLTSKQEEDKVLKYLPFAAGRRGCPATNVGYIFVGISIGMMVQCFDWSIKEKVSMEEVYAGMSLSMAHPPTCTPVSRLSL

SEQ ID NO: 174 - protein, 502 aa, Siraitia grosvenorii
MDFFSAFLLLLLTVLILLQIRTRRRNLPPSPPSLPIIGHLHLLKRPIHRNFHKIAAEYGPIFSLRFGSRLAVIVSSLDIAEECFTKNDLIFANRPRLLISKHLGYNCTTMATSPYGDHWRNLRRLAAIEIFSTARLNSSLSIRKDEIQRLLLKLHSGSSGEFTKVELKTMFSELAFNALMRIVAGKRYYGDEVSDEEEAREFRGLMEEISLHGGASHWVDFMPILKWIGGGGFEKSLVRLTKRTDKFMQALIEERRNKKVLERKNSLLDRLLELQASEPEYYTDQIIKGLVLVLLRAGTDTSAVTLNWAMAQLLNNPELLAKAKAELDTKIGQDRPVDEPDLPNLSYLQAIVSETLRLHPAAPMLLSHYSSADCTVAGYDIPRGTTLLVNAWAIHRDPKLWDDPTSFRPERFLGAANELQSKKLIAFGLGRRSCPGDTMALRFVGLTLGLLIQCYQWKKCGDEKVDMGEGGGITIHKAKPLEAMCKARPAMYKLLLNALDKI

SEQ ID NO: 175 - protein, 514 aa, Camelina sativa
MATMMIFDFQNCFIFIILCFVSLLCYTILFKKQESSRTGCVLPPSPPSLPIIGHLHLLLSSLTHKSLHNISSKFGPFLYLRVVNLPIVLVSSASVAYEIYKTQDVNVSSRVATSLGDSLFLGSSGFITAPYGDYWKFMKKMVATKLLRPQAIEQSRGGRAEELQGLYENLLDKAMKKESIEISKEAMKFTNNIICRMSMGRSCSDENGEAEIVRELLVKSTALTKKIFFANMFPRIPLFKKEIMGVSNQFDELLERLLVEHEERVEEHENKDMMDLLLEAFRDEHAEYKISRKQIKSLFVEIFLGGTDTSAQTVQWIMAELINKPSIIEKIREEIDSVVGKTRLIKETDLPKLPYLQVVVKEGLRMHPPSPLVVRTFQESCEVKGFYMPEKTMLVINVYALMRDPESWEDPNEFKPERFLPSSKSRQDEEKEQGLKYLPFGAGRRGCPGSNLAYLFVGLAVGVMVQCFDWKIKEDKVNMEETTAGMNLAMAHPFKCTPVVRIDPLTFNLKSPSP

SEQ ID NO: 176 - protein, 499 aa, Raphanus sativus
MAPMTIDFQTCFIFILLSFFSFFCYFFFFKKTNDLGPSPPSLPIIGHLHHFLSVLPHKAFQQISTKYGPLLHLRIFSFPIVLVSSATMAYEIFTTHDLNISSRNAPAIDESLVFGSSGFIVSPYGDYVKFIKKLLATKLLRPRAIEKSRGVRAEELKQFYLKLHDKALKKESIEIGNETMKFTNNMICGMSMGRSCSEENGETETVRGLINKSFALSRKILFVNVLRRPLEKLGLLSLFKKDILDVSNRFDELLERILLEHEEKPEEEQDMDMMDLLLEASRDENAEYKITRNQIKALFVEIFMGGTDTSAHTTQWTMAELVNNPNSLEKLRDEIDMVVGKSRLIQETDLPNLPYLQAVVKEGLRLHPPAPLLVRMFEKKCVIKDFFNVPEKTTLVVNLYGVMRDPDSWEDPNEFKPERFLTSKQEEEKTLKYLPFAAGRRGCPATNVAYIFVGISIGMMVQCFDWSIKDKVSMEEVYAGMSLSMAHPPKFTPVSRLSL

SEQ ID NO: 177 - protein, 522 aa, Ononis spinosa
MVDPYAVGWIICSLTTIVALYNFVFYRQNRSDKTTPTTTENITTATGDCRSLNPNGDVDIVIVGAGVAGSALAYTLGKDGRRVLVIERDLNEPDRIVGELLQPGGYLKLIELGLEDCVEKIDAQQVFGYALFKDGKHTRLSYPLEKFHSDIAGRSFHNGRFIQRMREKAASLPNVQLVQGTVTSLLEENGTIKGVQYKTKDAQELSACAPLTIVCDGCFSNLRRNLCNPKVEVPSCFVGLVLENCELPCANHGHVILGDPSPVLFYPISSTEIRCLVDVPGQKVPSISNGEMAKYLKEVVAPQVPPELHDAFIAAVDKGNIRTMPNRSMPAAPYPTPGALLMGDAFNMRHPLTGGGMTVALSDIVVLRNLLKPLRDLNDAPSLCKYLESFYTLRKPVASTINTLAGALYKVFCASPDPARKEMRQACFDYLSLGGLFSEGPVSLLSGLNPRPLSLVLHFFAVAIYGVGRLLLPFPSPKRIWIGVRLIASASGIILPIIKAEGIRQMFFPATVPAYYRTPPAA

SEQ ID NO: 178 - protein, 525 aa, Ononis spinosa
MDLYLLGWILSSVLSLFALYCLVFDGNRSRANAEKQIQRGYSVTTDAGDVKSEKLNGDADVIIVGAGIAGAALAHTLGKDGRRVRVIERDLSEPDRIVGELLQPGGYLKLVELGLADCVDNIDAQKVFGYALFKDGKHTRLSYPLEKFHADVSGRSFHNGRFIQRMREKAASLLNVNLEQGTVTSLLEEKGTIKGVQYKNKDGQELTAYAPLTIVCDGCFSNLRRSLCNPKVDNPSCFVGLVLENCELPCANHGHVILGDPSPILFYPISSTEIRCLVDVPGQKVPSISNGDMTKYLKLTVAPQVPPELYDAFIAAVDKGNIRTMPNKSMPADPCPTPGAVLMGDAFNMRHPLTGGGMTVALSDIVVLRNLLRPLRDLNDAPALCKYLESFYTLRKPVASTINTLAGALYKVFSSSPDQARREMRQACFDYLSLGGLFSEGPISLLSGLNPRPLSLVLHFFAVAVFGVGRLLLPFPSPKRVWIGARLLSAASGIILPIIKAEGIRQMFFPVTVPAYYRAPPTSQE

SEQ ID NO: 179 - protein, 519 aa, Medicago truncatula
MIDPYGFGWITCTLITLAALYNFLFSRKNHSDSTTTENITTATGECRSFNPNGDVDIIIVGAGVAGSALAYTLGKDGRRVLIIERDLNEPDRIVGELLQPGGYLKLIELGLDDCVEKIDAQKVFGYALFKDGKHTRLSYPLEKFHSDIAGRSFHNGRFILRMREKAASLPNVRLEQGTVTSLLEENGTIKGVQYKTKDAQEFSACAPLTIVCDGCFSNLRRSLCNPKVEVPSCFVGLVLENCELPCADHGHVILGDPSPVLFYPISSTEIRCLVDVPGQKVPSISNGEMAKYLKTVVAPQVPPELHAAFIAAVDKGHIRTMPNRSMPADPYPTPGALLMGDAFNMRHPLTGGGMTVALSDIVVLRNLLKPLRDLNDASSLCKYLESFYTLRKPVASTINTLAGALYKVFCASPDPARKEMRQACFDYLSLGGLFSEGPVSLLSGLNPCPLSLVLHFFAVAIYGVGRLLLPFPSPKRLWIGIRLIASASGIILPIIKAEGIRQMFFPATVPAYYRAPPDA

SEQ ID NO: 180 - protein, 525 aa, Medicago truncatula
MDLYNIGWILSSVLSLFALYNLIFAGKKNYDVNEKVNQREDSVTSTDAGEIKSDKLNGDADVIIVGAGIAGAALAHTLGKDGRRVHIIERDLSEPDRIVGELLQPGGYLKLVELGLQDCVDNIDAQRVFGYALFKDGKHTRLSYPLEKFHSDVSGRSFHGRFIQRMREKAASLPNVNMEQGTVISLLEEKGTIKGVQYKNKDGQALTAYAPLTIVCDGCFSNLRRSLCNPKVDNPSCFVGLILENCELPCANHGHVILGDPSPILFYPISSTEIRCLVDVPGTKVPSISNGDMTKYLKTTVAPQVPPELYDAFIAAVDKGNIRTMPNRSMPADPRPTPGAVLMGDAFNMRHPLTGGGMTVALSDIVVLRNLLKPMRDLNDAPTLCKYLESFYTLRKPVASTINTLAGALYKVFSASPDEARKEMRQACFDYLSLGGLFSEGPISLLSGLNPRPLSLVLHFFAVAVFGVGRLLLPFPSPKRVWIGARLLSGASGIILPIIKAEGIRQMFFPATVPAYYRAPPVNAF

SEQ ID NO: 181 - protein, 461 aa, Hypholoma sublateritium
MSKSRSNYDVIIVGAGIAGCALAHGLSTLSRATPLRIAIVERSLAEPDRIVGELLQPGGVMALQRLGMEGCLEGIDAVKVHGYCVVENGTSVHIPYPGVHEGRSFHHGRFIMKLREAARAARGVELVEATVTELIPREGGKGIAGVRVARKGKDGEEDTTEALGAALVVVADGCFSNFRAAVMGGAAVKPETKSHFVGAILKDARLPIPNHGTVALVKGFGPVLLYQISEHDTRMLVDVKAPLPADLKVCAHILSNIVPQLPAALHLPIQRALDAERLRRMPNSFLPPVEQGATRGAVLVGDAWNMRHPLTGGGMTVALNDVVVLRDLLGSVGDLGDWRQVASTVNILSVALYDLFGADGELQVLRTGCFKYFERGGDCIDGPVSLLSGIAPSPMLLAYHFFSVAFYSIYVIAVGAQNGSAKQVLAVPGALQYPALCVKGLRVFYTACVVFGPLLWTELRW

SEQ ID NO: 182 - protein, 498 aa, Hypholoma sublateritium
MHPTHYDVVIVGAGVAGSSLAHALATLPREKPLQIALIERSFEEPDRIVGELLQPGGVDALKTLKMTSSVEGIDAITVTGYILVESGDMVRIPYPKGKEGRSFHHGRFIMGLRRVALENPNVHPIEATAADLIECPCTGQVIGVRATSKTAPAPSSIDAQQTPPAPFSVYGDLVIVADGCFSNFRNVVMGKAACKATTKSYFVGTILKDAVLPVAGHGTVILPQGSGPVLLYQISEHDTRMLIDIQHPLPSDLRAHILTNILPQLPASIQGVVSDAFTKDRIRRMPNSFLPSVQQGSPLSKKGVILLGDSWNMRHPLTGGGMTVALNDVVYLRSIFASIQNLDDWDEIRYALRHWHWGRKPLSSTINILSGTLYGLFEKDDDDYRALRKGCFKYFQLGGKCIDDPVSLLSGLSPSPLLLSSHFFAVILYAIWVVFTHPRVGSSMSANPADVKRVYDIPSADEYPQLTLKGIRMFSQACGVFLPVLWSEIRWWAPCESS

SEQ ID NO: 183 - protein, 524 aa, Hypholoma sublateritium
MSKSRSNYDVIIVGAGIAGCALAHGLSTLSRATPLRIAIVERSLAEPDRIVGELLQPGGVMALQRLGMEGCLEGIDAVKVHGYCVVENGTSVHIPYPGVHEGRSFHHGRFIMKLREAARAARGVELVEATVTELIPREGGKGIAGVRVARKGKDGEEDTTEALGAALVVVADGCFSNFRAAVMGGAAVKPETKSHFVGAILKDARLPIPNHGTVALVKGFGPVLLYQISEHDTRMLVDVKAPLPADLKAHILSNIVPQLPAALHLPIQRALDAERLRRMPNSFLPPVEQGATRGAVLVGDAWNMRHPLTGGGMTVALNDVVVLRDLLGSVGDLGDWRQVRRALHRWHWDRKPLASTVNILSVALYDLFGADGEELQVLRTGCFKYFERGGDCIDGPVSLLSGIAPSPMLLAYHFFSVAFYSIYVMFAHPQPVAQSKAVGAQNGSAKQVLAVPGALQYPALCVKGLRVFYTACVVFGPLLWTELRWWTAAEASRGRLLVMSLVPLLLLLGAANYGIPGMGLLGVL

SEQ ID NO: 184 - protein, 317 aa, Gossypium raimondii
MAEKIEHTTVTTNGIKMHVASIGSGPIILFLHGFPELWYTWRHQLLSLSSLGYRCVAPDLRGYGDSDAPPSPESYTVFHIVGDLVGLLDALGVDKVFLVGHDWGAMIAWNFCLFRPDRIKALVNLSIPYHPRNPKVKTVDGYRALFGDDFYICRFQVPGEAEAHFAQMDTAKVMKKFLTTRDPNPPCIPRETGLKALPDPPALPSWLSEDEINYFATKFSQKGFTGGLNYYRAMNLNWELMAPWTGLQIQVPVKFIVGDLDITYHIPGVKEYLQNGGFKKNVPFLQELVVMEGVAHFINQEKPQEISMHIYDFIKKF

SEQ ID NO: 185 - protein, 317 aa, Gossypium hirsutum
MAEKIEHTTVTTNGIKMHVASIGSGPIILFLHGFPELWYTWRRQLLSLSSLGYRCVAPDLRGYGDSDAPPSPESYTVFHVVGDLVGLLDALGVDKVFLVGHDWGAMIAWNFCLFRPDRIKALVNLSVPYHPRNPKVKTVDGYRALFGDDFYICRFQVPGEAEAHFAQMDTAKVLKKFLTTRDPNPPCIPKETGLKALPDPPALPSWLSEDEINYFATKFNQKGFTGGLNYYRAMNLNWELMAPWTGLQIQVPVKFIVGDLDITYHIPGVKEYLQNGGFKKNVPFLQELVVMEGVAHFINQEKPQEISMHIYDFVKKF

SEQ ID NO: 186 - protein, 317 aa, Siraitia grosnevorii
MAENIEHTTVQTNGIKMHVAAIGTGPPVLLLHGFPELWYSWRHQLLYLSSAGYRAIAPDLRGYGDTDAPPSPSSYTALHIVGDLVGLLDVLGIEKVFLIGHDWGAIIAWYFCLFRPDRIKALVNLSVQFFPRNPTTPFVKGFRAVLGDQFYMVRFQEPGKAEEEFASVDIREFFKNVLSNRDPQAPYLPNEVKFEGVPPPALAPWLTPEDIDVYADKFAETGFTGGLNYYRAFDRTWELTAPWTGARIGVPVKFIVGDLDLTYHFPGAQKYIHGEGFKKAVPGLEEVVVMEDTSHFINQERPHEINSHIHDFFSKFC

SEQ ID NO: 187 - protein, 316 aa, Cucumis melo
MADKIQHSTISTNGINIHFASIGSGPVVLFLHGFPELWYSWRHQLLFLASKGFRAIAPDLRGFGDSDAPPSPSSYTPHHIVGDLIGLLDHLGIDQVFLVGHDWGAMMAWYFCLFRPDRVKALVNLSVHYTPRNPAGSPLAVTRRYLGDDFYICKFQEPGVAEADFGSVDTATMMKKFLTMRDPRPAIIPNGFKTLLETPEILPSWLTEEDIEYFASKFSKTGFTGGFNYYRALDITWELTGPWSRAQIKVPTKFIVGDLDLVYNFPGAKEYIHGGGFKKDVPLLEDVVVIEGAAHFINQEKPDEISSLIYDFITKF

SEQ ID NO: 188 - protein, 325 aa, Cucumis melo
MAEKIEHTTIPTNGINMHVASIGSGPAVLFLHGFPQLWYSWRHQLLFLASKGFRALAPDLRGFGDTDAPPSPSSYTFLHIIGDLIGLLDHLGLEKVFLVGHDWGAMIAWYFCLFRPDRVKALVNLSVYYIKRHPSISFVDGFRAVAGDNFYICQFQEAGVAEADFGRVDTATMMKKFMGMRDPEAPLIFTKEKGFSSMETPDPLPCWLTEEDIDFFATKFSKTGFTGGFNYYRALNLSWELTAAWNGSKIEVPVKFIVGDLDLVYHFPGAKQYIHGGEFKKDVPFLEEVVVIKDAAHFIHQEKPHQINSLIYHFINKFSTSTSPA

SEQ ID NO: 189 - protein, 316 aa, Trema orientale
MAEKIEHTTINTNGVNLHVASIGTGPAVLFLHGFPELWYSWRHQMLALSSLGYRAIAPDLRGYGDSDAPPSPESYSSLHIVGDLVGLIDQLGIDQIFLVGHDWGAVIAWQFCLFRPDRVKALVNMSVPFRPRHPTRKPIETFRALFGDDYYVCRFQAPGEVEEDFASDDTANLLKKFYGGRNPRPPCVPKEIGFKGLKAPELPSWLSEEDLNYFAEKFNQRGFTGGLNYYRALDLTWELTAAWTGVQVKVPTKFIVGDLDITYHIPGAKEYINEGGLKKDVPYLQEVVVMEGVAHFVNQEKAEEVSAHIHDFIKKF

SEQ ID NO: 190 - protein, 318 aa, Arachis hypogaea
MAEKIEHTWVNTNGIKMHVASIGSGPAVLFLHGFPELWYSWRHQLLSLSAQGYRCIAPDLRGYGDTDAPPSPSSYSALHIVSDLVGLLDALRIDQVFLVGHDWGAAMAWYFCLFRPDRIKALVNMSVVFRPRNPKWKPLQSLRAMLGDDYYICRFQKPGEAEEEFARAGTSRIIKTFLVSRDPRPPCVPKEIGFGGSPNLQLALPSWLTEEDVNYYASKFDQKGFTGGLNYYRAIDLTWELTAPWTGVQIKVPVKFIVGDLDVTYNTPGVKEYIHGGGFKKEVPFLQELVVMEGVAHFINQERPDEISAHIHDFIKKF

SEQ ID NO: 191 - protein, 757 aa, Pisum sativum cycloartenol synthase
MAWKLKVAEGGTPWLRTLNNHVGRQVWEFDPHSGSPQDLDDIETARRNFHDNRFTHKHSDDLLMRLQFAKENPMNEVLPKVKVKDVEDVTEEAVATTLRRGLNFYSTIQSHDGHWPGDLGGPMFLMPGLVITLSVTGALNAVLTDEHRKEMRRYLYNHQNKDGGWGLHIEGPSTMFGSVLCYVTLRLLGEGPNDGEGDMERGRDWILEHGGATYITSWGKMWLSVLGVFEWSGNNPMPPEIWLLPYALPVHPGRMWCHCRMVYLPMSYLYGKRFVGPITPTVLSLRKELFTVPYHDIDWNQARNLCAKEDLYYPHPLVQDILWATLHKFVEPVFMNWPGKKLREKAIKTAIEHIHYEDENTRYICIGPVNKVLNMLCCWVEDPNSEAFKLHLPRIYDYLWVAEDGMKMQGYNGSQLWDTAFAAQAIISTNLIDEFGPTLKKAHAFIKNSQVSEDCPGDLSKWYRHISKGAWPFSTADHGWPISDCTAEGLKAVLLLSKIAPEIVGEPLDSKRLYDAVNVILSLQNENGGLATYELTRSYTWLEIINPAETFGDIVIDCPYVECTSAAIQALATFGKLYPGHRREEIQCCIEKAVAFIEKIQASDGSWYGSWGVCFTYGTWFGIKGLIAAGKNFSNCLSIRKACEFLLSKQLPSGGWAESYLSCQNKVYSNLEGNRSHVVNTGWAMLALIEAEQAKRDPTPLHRAAVCLINSQLENGDFPQEEIMGVFNKNCMITYAAYRCIFPIWALGEYRRVLQAC

SEQ ID NO: 192 - protein, 767 aa, Cucurbita pepo subsp. pepo cycloartenol synthase
MAWQLKIGADTVPSDPSNAGGWLSTLNNHVGRQVWHFHPELGSPEDLQQIQQARQHFSDHRFEKKHSADLLMRMQFAKENSSFVNLPQVKVKDKEDVTEEAVTRTLRRAINFYSTIQADDGHWPGDLGGPMFLIPGLVITLSITGALNAVLSTEHQREICRYLYNHQNKDGGWGLHIEGPSTMFGSVLNYVTLRLLGEEAEDGQGAVDKARKWILDHGGAAAITSWGKMWLSVLGVYEWAGNNPLPPELWLLPYLLPCHPGRMWCHCRMVYLPMCYLYGKRFVGPITPIIRSLRKELYLVPYHEVDWNKARNQCAKEDLYYPHPLVQDILWATLHHVYEPLFMHWPAKRLREKALQSVMQHIHYEDENTRYICIGPVNKVLNMLCCWAEDPHSEAFKLHIPRIYDYLWIAEDGMKMQGYNGSQLWDTAFAVQAIISTELAEEYETTLRKAHKYIKDSQVLEDCPGDLQSWYRHISKGAWPFSTADHGWPISDCTAEGLKAVLLLSKLPSEIVGKSIDEQQLYNAVNVILSLQNTDGGFATYELTRSYRWLELMNPAETFGDIVIDYPYVECSSAAIQALAAFKKLYPGHRRDEIDNCIAEAADFIESIQATDGSWYGSWGVCFTYGGWFGIRGLVAAGRRYNNCSSLRKACDFLLSKELAAGGWGESYLSCQNKVYTNIKDDRPHIVNTGWAMLSLIDAGQSERDPTPLHRAARVLINSQMEDGDFPQEEIMGVFNKNCMISYSAYRNIFPIWALGEYRSRVLKPLK

SEQ ID NO: 193 - protein, 761 aa, Zostera marina cycloartenol synthase
MAWKLKVAEGRDARLRTINGHVGRQIWEFDPDLGTDNERAEVEAVREKFRNNRFEKKHSSDLLMRLQLAKENPVSSYLTQVKLEENEDITEEAVTMTLRRALNFHSSIQSFDGHWAGDLGGPMFLMPGLVISLYITGVLNTVLSSEHQREMCRYLYNHQNEDGGWGLHIEGPSTVFGSTLTYITLRLLGENVEDGDGAMEKGRKWILDHGGATYITSWGKMWLSVLGVFDWSGNNPLPPEMWLLPYFLPVHPGRMWCHCRMVYLPMSYLYGKRFVGKITPLVLSLRNEIYTVSYNQIDWNKARNLCAKEDLYYPHPMVQDILWATLHKFVEPILMHWPGTLLREKALNTTMQHIHYEDESTRYICIGPVNKVLNMLCCWVDDPDSEAFKLHLPRISDYLWIAEDGMKCQGYNGSQLWDTAFAVQAYIATNLSDEFGPVLTKAHEYIKNSQVPDDCSGDLSFWYRHISKGAWPFSTGDHGWPISDCTAEGLKASLLLSRISPEVVGKPLNAKRFYDAVNVILSLMNSDGSFATYELTRSYTWLEMINPAETFGDIVIDYPYVECTSAAIQSLVAFTKLYPGHRREEIDECITKAAKFIESIQKKDGSWYGSWAVCFTYGLWFGIKGLIAAGKTYKNSSAIRKACEFLLSKQLASGGWGESYLSCQDKVYTNLEGNRAHAVNTGWAMLSLIDAGQAERDPSPLHRAARVLINSQMGNGDFPQEEIMGVFNRNCMISYSAYRNIFPIWALGEYRCKVLASKGHE

SEQ ID NO: 194 - protein, 475 aa, Cucumis sativus
MAWTILLGLATLAIAYYIHWVNKWKDSKFNGVLPPGTMGLPLIGETIQLSRPSDSLDVHPFIQRKVKRYGPIFKTCLAGRPVVVSTDAEFNHYIMLQEGRAVEMWYLDTLSKFFGLDTEWLKALGLIHKYIRSITLNHFGAESLRERFLPRIEESARETLHYWSTQTSVEVKESAAAMVFRTSIVKMFSEDSSKLLTEGLTKKFTGLLGGFLTLPLNLPGTTYHKCIKDMKQIQKKLKDILEERLAKGVKIDEDFLGQAIKDKESQQFISEEFIIQLLFSISFASFESISTTLTLILNFLADHPDVVKELEAEHEAIRKARADPDGPITWEEYKSMNFTLNVICETLRLGSVTPALLRKTTKEIQIKGYTIPEGWTVMLVTASRHRDPEVYKDPDTFNPWRWKELDSITIQKNFMPFGGGLRHCAGAEYSKVYLCTFLHILFTKYRWRKLKGGKIARAHILRFEDGLYVNFTPKE

SEQ ID NO: 195 - protein, 485 aa, Cucumis sativus
MALLSEYGLFLAKIVTVVLAIAAIAAIIHWVNKWKDSKFNGVLPPGTMGLPLIGETIQLSRPSDSLDVHPFIQRKVKRYGPIFKTCLAGRPVVVSTDAEFNHYIMLQEGRAVEMWYLDTLSKFFGLDTEWLKALGLIHKYIRSITLNHFGAESLRERFLPRIEESARETLHYWSTQTSVEVKESAAAMVFRTSIVKMFSEDSSKLLTEGLTKKFTGLLGGFLTLPLNLPGTTYHKCIKDMKQIQKKLKDILEERLAKGVKIDEDFLGQAIKDKESQQFISEEFIIQLLFSISFASFESISTTLTLILNFLADHPDVVKELEAEHEAIRKARADPDGPITWEEYKSMNFTLNVICETLRLGSVTPALLRKTTKEIQIKGYTIPEGWTVMLVTASRHRDPEVYKDPDTFNPWRWKELDSITIQKNFMPFGGGLRHCAGAEYSKVYLCTFLHILFTKYRWRKLKGGKIARAHILRFEDGLYVNFTPKE

SEQ ID NO: 196 - protein, 482 aa, Cucumis sativus
MAQDLRLILIIVGAIAIIALLVHGFHWVNKWKDSKFNGVLPPGTMGLPLIGETIQLSRPSDSLDVHPFIQRKVKRYGPIFKTCLAGRPVVVSTDAEFNHYIMLQEGRAVEMWYLDTLSKFFGLDTEWLKALGLIHKYIRSITLNHFGAESLRERFLPRIEESARETLHYWSTQTSVEVKESAAAMVFRTSIVKMFSEDSSKLLTEGLTKKFTGLLGGFLTLPLNLPGTTYHKCIKDMKQIQKKLKDILEERLAKGVKIDEDFLGQAIKDKESQQFISEEFIIQLLFSISFASFESISTTLTLILNFLADHPDVVKELEAEHEAIRKARADPDGPITWEEYKSMNFTLNVICETLRLGSVTPALLRKTTKEIQIKGYTIPEGWTVMLVTASRHRDPEVYKDPDTFNPWRWKELDSITIQKNFMPFGGGLRHCAGAEYSKVYLCTFLHILFTKYRWRKLKGGKIARAHILRFEDGLYVNFTPKE

SEQ ID NO: 197 - protein, 475 aa, Cucumis sativus
MAWTILLGLATLAIAYYIHWVNKWKDSKFNGVLPPGTMGLPLIGETIQFSRPSDSLDVHPFIQRKVKRYGPIFKTCIAGRPVVVSTDAEFNHYIMLQEGRAVEMWYLDTFSKFLGLDTEWLKALGLIHKYIRSITLNHFGAESLRERFLPRIEESARETLHYWSTQTSVEVKESAAAMVFRTSIVKMFSEDSSKLLTEGLTKKFTGLLGGFLTLPLNLPGTTYHKCIKDMKQIQKKLKDILEERLAKGVKIDEDFLGQAIKDKESQQFISEEFIIQLLFSISFASFASISTTLTLILNFLADHPDVVKELEAEHEAIRKARADPDGPITWEEYKSMNFTLNVICETLRLGSVTPALLRKTTKEIQIKGYTIPEGWTVMLVTASRHRDPEVYKDPDTFNPWRWKELDSITIQKNFMPFGGGLRHCAGAEYSKVYLCTFLHILFTKYRWRKLKGGKIARALILRFEDGLYVNFTPKE

SEQ ID NO: 198 - protein, 485 aa, Cucumis sativus
MALLSEYGLFLAKIVTVVLAIAAIAAIIHWVNKWKDSKFNGVLPPGTMGLPLIGETIQFSRPSDSLDVHPFIQRKVKRYGPIFKTCIAGRPVVVSTDAEFNHYIMLQEGRAVEMWYLDTFSKFLGLDTEWLKALGLIHKYIRSITLNHFGAESLRERFLPRIEESARETLHYWSTQTSVEVKESAAAMVFRTSIVKMFSEDSSKLLTEGLTKKFTGLLGGFLTLPLNLPGTTYHKCIKDMKQIQKKLKDILEERLAKGVKIDEDFLGQAIKDKESQQFISEEFIIQLLFSISFASFASISTTLTLILNFLADHPDVVKELEAEHEAIRKARADPDGPITWEEYKSMNFTLNVICETLRLGSVTPALLRKTTKEIQIKGYTIPEGWTVMLVTASRHRDPEVYKDPDTFNPWRWKELDSITIQKNFMPFGGGLRHCAGAEYSKVYLCTFLHILFTKYRWRKLKGGKIARALILRFEDGLYVNFTPKE

SEQ ID NO: 199 - protein, 485 aa, Cucurbita pepo subsp. pepo
MALLSEYGLFLAKIVTVVLAIAAIAAIIHWINKWKDSKFNGVLPPGTMGLPLVGETLQLARPSDSLDVHPFIKKKVKRYGPIFKTCLAGRPVVVSTDAEFNNYIMLQEGRAVEMWYLDTLSKFFGLDTEWLKALGFIHKYIRSITLNHFGAESLRERFLPRIEESAKETLRYWATQPSVEVKDSAAVMVFRTSMVKMVSEDSSKLLTGGLTKKFTGLLGGFLTLPINVPGTTYNKCMKDMKEIQKKLREILEGRLASGGGSDEDFLGQAIKDKGSQQFISDDFIIQLLFSISFASFESISTTLTLVLNYLADHPDVVKELEAEHEAIRNARADPDGPITWEEYKSMTFTLHVIFETLRLGSVTPALLRKTTKELQINGYTIPEGWTVMLVTASRHRDPAVYKDPHTFNPWRWKELDSITIQKNFMPFGGGLRHCAGAEYSKVYLCTFLHILFTKYRWTKLKGGKVARAHILSFEDGLHVKFTPKE

SEQ ID NO: 200 - protein, 465 aa, Cucurbita pepo subsp. pepo
MALLLAVFHWINKWKDSKFNGVLPPGTMGLPLVGETLQLARPSDSLDVHPFIKKKVKRYGPIFKTCLAGRPVVVSTDAEFNNYIMLQEGRAVEMWYLDTLSKFFGLDTEWLKALGFIHKYIRSITLNHFGAESLRERFLPRIEESAKETLRYWATQPSVEVKDSAAVMVFRTSMVKMVSEDSSKLLTGGLTKKFTGLLGGFLTLPINVPGTTYNKCMKDMKEIQKKLREILEGRLASGGGSDEDFLGQAIKDKGSQQFISDDFIIQLLFSISFASFESISTTLTLVLNYLADHPDVVKELEAEHEAIRNARADPDGPITWEEYKSMTFTLHVIFETLRLGSVTPALLRKTTKELQINGYTIPEGWTVMLVTASRHRDPAVYKDPHTFNPWRWKELDSITIQKNFMPFGGGLRHCAGAEYSKVYLCTFLHILFTKYRWTKLKGGKVARAHILSFEDGLHVKFTPKE

SEQ ID NO: 201 - protein, 709 aa, Camptotheca acuminate
MAQSSSVKVSTFDLMSAILRGRSMDQTNVSFESGESPALAMLIENRELVMILTTSVAVLIGCFVVLLWRRSSGKSGKVTEPPKPLMVKTEPEPEVDDGKKKVSIFYGTQTGTAEGFAKALAEEAKVRYEKASFKVIDLDDYAADDEEYEEKLKKETLTFFFLATYGDGEPTDNAARFYKWFMEGKERGDWLKNLHYGVFGLGNRQYEHFNRIAKVVDDTIAEQGGKRLIPVGLGDDDQCIEDDFAAWRELLWPELDQLLQDEDGTTVATPYTAAVLEYRVVFHDSPDASLLDKSFSKSNGHAVHDAQHPCRANVAVRRELHTPASDRSCTHLEFDISGTGLVYETGDHVGVYCENLIEVVEEAEMLLGLSPDTFFSIHTDKEDGTPLSGSSLPPPFPPCTLRRALTQYADLLSSPKKSSLLALAAHCSDPSEADRLRHLASPSGKDEYAQWVVASQRSLLEVMAEFPSAKPPIGAFFAGVAPRLQPRYYSISSSPRMAPSRIHVTCALVFEKTPVGRIHKGVCSTWMKNAVPLDESRDCSWAPIFVRQSNFKLPADTKVPVLMIGPGTGLAPFRGFLQERLALKEAGAELGPAILFFGCRNRQMDYIYEDELNNFVETGALSELIVAFSREGPKKEYVQHKMMEKASDIWNMISQEGYIYVCGDAKGMARDVHRTLHTIVQEQGSLDSSKTESMVKNLQMNGRYLRDVW

SEQ ID NO: 202 - protein, 496 aa, Arabidopsis thaliana
MATEKTHQFHPSLHFVLFPFMAQGHMIPMIDIARLLAQRGVTITIVTTPHNAARFKNVLNRAIESGLAINILHVKFPYQEFGLPEGKENIDSLDSTELMVPFFKAVNLLEDPVMKLMEEMKPRPSCLISDWCLPYTSIIAKNFNIPKIVFHGMGCFNLLCMHVLRRNLEILENVKSDEEYFLVPSFPDRVEFTKLQLPVKANASGDWKEIMDEMVKAEYTSYGVIVNTFQELEPPYVKDYKEAMDGKVWSIGPVSLCNKAGADKAERGSKAAIDQDECLQWLDSKEEGSVLYVCLGSICNLPLSQLKELGLGLEESRRSFIWVIRGSEKYKELFEWMLESGFEERIKERGLLIKGWAPQVLILSHPSVGGFLTHCGWNSTLEGITSGIPLITWPLFGDQFCNQKLVVQVLKAGVSAGVEEVMKWGEEDKIGVLVDKEGVKKAVEELMGDSDDAKERRRRVKELGELAHKAVEKGGSSHSNITLLLQDIMQLAQFKN

SEQ ID NO: 203 - protein, 438 aa, MlSQE
MAKEEFDICIIGAGMAGATISAYLAPKGIKIALIDRCYKEKKRIVGELLQPGAVLSLEQMGLSHLLDGFEAQTVKGYALLQGNEKTTIPYPSQHEGIGLHNGRFLQQIRASALENSSVTQIHGKALQLLENERNEIIGVSYRESITSQIKSIYAPLTITSDGFASNFRAHLSNNQKTVTSYFIGLILKDCEMPFPKHGHVFLSGPTPFICYPISDNEVRLLIDFPGEQLPRKNLLQEHLDTNVTPYIPECMRSSYAQAIQEGGFKVMPNHYMAAKPIVRKGAVLLGDALNMRHPLTGGGLTAVFSDIQILSAHLLAMPDFKNTDLIHEKIEAYYRDRKRANANLNILANALYAVMSNDLLKTAVFKYLQCGGANAQESIALLAGLNRKHFSLIKQYCFLAVFGACNLLQQSISNIPKALKLLKDAFVIIKPLIKNELS

SEQ ID NO: 204 - protein, 466 aa, Hordeum vulgare subsp. Vulgare HvUGT_B1
MAQAESERMRVVMFPWLAHGHINPYLELAKRLIASASGDHHLDVVVHLVSTPANLAPLAHHQTDRLRLVELHLPSLPDLPPALHTTKGLPARLMPVLKRACDLAAPRFGALLDELCPDILVYDFIQPWAPLEAEARGVPAFHFATCGAAATAFFIHCLKTDRPPSAFPFESISLGGVDEDAKYTALVTVREDSTALVAERDRLPLSLERSSGFVAVKSSADIERKYMEYLSQLLGKEIIPTGPLLVDSGGSEEQRDGGRIMRWLDGEEPGSVVFVSFGSEYFMSEHQMAQMARGLELSGVPFLWVVRFPNAEDDARGAARSMPPGFEPELGLVVEGWAPQRRILSHPSCGAFLTHCGWSSVLESMAAGVPMVALPLHIDQPLNANLAVELGAAAARVKQERFGEFTAEEVARAVRAAVKGKEGEAARRRARELQEVVARNNGNDGQIATLLQRMARLCGKDQAVPN

SEQ ID NO: 205 - protein, 476 aa, Hordeum vulgare subsp. Vulgare HvUGT_B3
MAEANDGGKMHVVMLPWLAFGHVLPFTEFAKRVARQGHRVTLLSAPRNTRRLIDIPPGLAGLIRVVHVPLPRVDGLPEHAEATIDLPSDHLRPCLRRAFDAAFERELSRLLQEEAKPDWVLVDYASYWAPTAAARHGVPCAFLSLFGAAALSFFGTPETLLGIGRHAKTEPAHLTVVPEYVPFPTTVAYRGYEARELFEPGMVPDDSGVSEGYRFAKTIEGCQLVGIRSSSEFEPEWLRLLGELYRKPVIPVGLFPPAPQDDVAGHEATLRWLDGQAPSSVVYAAFGSEVKLTGAQLQRIALGLEASGLPFIWAFRAPTSTETGAASGGLPEGFEERLAGRGVVCRGWVPQVKFLAHASVGGFLTHAGWNSIAEGLAHGVRLVLLPLVFEQGLNARNIVDKNIGVEVARDEQDGSFAAGDIAAALRRVMVEDEGEGFGAKVKELAKVFGDDEVNDQCVREFLMHLSDHSKKNQGQD

SEQ ID NO: 206 - protein, 463 aa, MbUGT1,2.2; identical to SEQ ID NO: 163

SEQ ID NO: 207 - protein, 453 aa, Coffea canephora
MAENHATFNVLMLPWLAHGHVSPYLELAMKLTARNFNVYLCSSPATLSSVRSKLTEKFSQSIHLVELHLPKLPELPAEYHTTNGLPPHLMPTLKDAFDMAKPNFCNVLKSLKPDLLIYDLLQPWAPEAASAFNIPAVVFISSSATMTSFGLHFFKNPGTKYPYGNTIFYRDYESVFVENLKKRDRDTYRVVNCMERSSKIILIKGFKEIEGKYFDYFSCLTGKKVVPVGPLVQDPVLDDEDCRIMQWLNKKEKGSTVFVSFGSEYFLSKEDMEEIAHGLELSNVDFIWVVRFPKGENIVIEETLPKGFFERVGERGLVVNGWAPQAKILTHPNVGGFVSHCGWNSVMESMKFGLPIVAMPMHLDQPINARLIEEVGAGVEVLRDSKGKLHRERMAETINKVTKEASGEPARKKARELQEKLELKGDEEIDDVVKELVQLCATKNKRNGLHCYN

SEQ ID NO: 208 - protein, 452 aa, Coffea eugenioides
MAENHATFNVLMLPWLAHGHVSPYLELAKKLTARNFNVYLCSSPATLSSVRSKLTEKFSQSIHLVELHLPKLPELPAEYHTTNGLPPHLMPTLKDAFDMAEPNFCNVLKSLKPDLLIYDLLQPWAPEAASAFNIPAVVFISSSATMTSFGLHFFKNPGTKYPYGNTIFYRDYESVFVENLKRRDRDTYRVVNCMERSSKIILIKGFKEIEGKYFDYFSCLTGKKVVPVGPLVQDPVLDDEDCRIMQWLNKKEKGSTVFVSFGSEYFLSKEDMEEIAHGLELSNVDFIWVVRFPKGENIVIEETLPKGFFERVGERGLVVNGWAPQAKILTHPNVGGFVSHCGWNSVMESMKFGLPIIAMPMHLDQPINARLIEEVGAGVEVLRDSKGKLHRERMAETINKVTKEASGESVRKKARELQEKLELKGDEEIDDVVKELVQLCATKNKRNGLHYN

SEQ ID NO: 209 - protein, 452 aa, Coffea eugenioides
MAENHATFNVLMLPWLAHGHVSPYLELAKKLTARNFNVYLCSSPATLSSVRSKLTEKFSQSIHLVELHLPKLPELPAEYHTTNGLPPHLMPTLKDAFDMAKPNFCNVLKSLKPDLLIYDLLQPWAPEAASAFNIPAVVFISSSATMTSFGLHFFKNPGTKYPYGNAIFYRDYESVFVENLTRRDRDTYRVINCMERSSKIILIKGFNEIEGKYFDYFSCLTGKKVVPVGPLVQDPVLDDEDCEIMQWLNKKEKVSTVFVSFGSEYFLSKKDMEEIAHGLELSNVDFIWVVRFPKGENIVIEETLPKGFFERVGERGLVVNGWAPQAKILTHPNVGGFVSHCGWNSVMESMKFGLPIIAMPMHLDQPINARLIEEVGAGVEVLRDSKGKLHRERMAETINKVMKEASGESVRKKARELQEKMDLKGDEEIDDVVKELVQLCATKNKRNGLHYY

SEQ ID NO: 210 - protein, 453 aa, Siraitia grosvenorii
MADAAQQGDTTTILMLPWLGYGHLSAFLELAKSLSRRNFHIYFCSTSVNLDAIKPKLPSSFSDSIQFVELHLPSSPEFPPHLHTTNGLPPTLMPALHQAFSMAAQHFESILQTLAPHLLIYDSLQPWAPRVASSLKIPAINFNTTGVFVISQGLHPIHYPHSKFPFSEFVLHNHWKAMYSTADGASTERTRKRGEAFLYCLHASCSVILINSFRELEGKYMDYLSVLLNKKVVPVGPLVYEPNQDGEDEGYSSIKNWLDKKEPSSTVFVSFGSEYFPSKEEMEEIAHGLEASEVNFIWVVRFPQGDNTSGIEDALPKGFLERAGERGMVVKGWAPQAKILKHWSTGGFVSHCGWNSVMESMMFGVPIIGVPMHVDQPFNAGLVEEAGVGVEAKRDPDGKIQRDEVAKLIKEVVVEKTREDVRKKAREMSEILRSKGEEKFDEMVAEISLLLKI

SEQ ID NO: 211 - protein, 474 aa, Oryza sativa
MAQAERERLRVLMFPWLAHGHINPYLELATRLTTTSSSQIDVVVHLVSTPVNLAAVAHRRTDRISLVELHLPELPGLPPALHTTKHLPPRLMPALKRACDLAAPAFGALLDELSPDVVLYDFIQPWAPLEAAARGVPAVHFSTCSAAATAFFLHFLDGGGGGGGRGAFPFEAISLGGAEEDARYTMLTCRDDGTALLPKGERLPLSFARSSEFVAVKTCVEIESKYMDYLSKLVGKEIIPCGPLLVDSGDVSAGSEADGVMRWLDGQEPGSVVLVSFGSEYFMTEKQLAEMARGLELSGAAFVWVVRFPQQSPDGDEDDHGAAAARAMPPGFAPARGLVVEGWAPQRRVLSHRSCGAFLTHCGWSSVMESMSAGVPMVALPLHIDQPVGANLAAELGVAARVRQERFGEFEAEEVARAVRAVMRGGEALRRRATELREVVARRDAECDEQIGALLHRMARLCGKGTGRAAQLGH

SEQ ID NO: 212 - protein, 357 aa, Mycobacterium tuberculosis
MASQVHRILNCRGTRIHAVADSPPDQQGPLVVLLHGFPESWYSWRHQIPALAGAGYRVVAIDQRGYGRSSKYRVQKAYRIKELVGDVVGVLDSYGAEQAFVVGHDWGAPVAWTFAWLHPDRCAGVVGISVPFAGRGVIGLPGSPFGERRPSDYHLELAGPGRVWYQDYFAVQDGIITEIEEDLRGWLLGLTYTVSGEGMMAATKAAVDAGVDLESMDPIDVIRAGPLCMAEGARLKDAFVYPETMPAWFTEADLDFYTGEFERSGFGGPLSFYHNIDNDWHDLADQQGKPLTPPALFIGGQYDVGTIWGAQAIERAHEVMPNYRGTHMIADVGHWIQQEAPEETNRLLLDFLGGLRP

SEQ ID NO: 213 - protein, 443 aa, Panax ginseng
MADNQNGRISIALLPFLAHGHISPFFELAKQLAKRNCNVFLCSTPINLSSIKDKDSSASIKLVELHLPSSPDLPPHYHTTNGLPSHLMLPLRNAFETAGPTFSEILKTLNPDLLIYDFNPSWAPEIASSHNIPAVYFLTTAAASSSIGLHAFKNPGEKYPFPDFYDNSNITPEPPSADNMKLLHDFIACFERSCDIILIKSFRELEGKYIDLLSTLSDKTLVPVGPLVQDPMGHNEDPKTEQIINWLDKRAESTVVFVCFGSEYFLSNEELEEVAIGLEISTVNFIWAVRLIEGEKKGILPEGFVQRVGDRGLVVEGWAPQARILGHSSTGGFVSHCGWSSIAESMKFGVPVIAMARHLDQPLNGKLAAEVGVGMEVVRDENGKYKREGIAEVIRKVVVEKSGEVIRRKARELSEKMKEKGEQEIDRALEELVQICKKKKDEQ

SEQ ID NO: 214 - protein, 499 aa, Stevia rebaudiana
MAHHHHHHVGTGSNDDDDKSPDPNWASTSELVFIPSPGAGHLPPTVELAKLLLHRDQRLSVTIIVMNLWLGPKHNTEARPCVPSLRFVDIPCDESTMALISPNTFISAFVEHHKPRVRDIVRGIIESDSVRLAGFVLDMFCMPMSDVANEFGVPSYNYFTSGAATLGLMFHLQWKRDHEGYDATELKNSDTELSVPSYVNPVPAKVLPEVVLDKEGGSKMFLDLAERIRESKGIIVNSCQAIERHALEYLSSNNNGIPPVFPVGPILNLENKKDDAKTDEIMRWLNEQPESSVVFLCFGSMGSFNEKQVKEIAVAIERSGHRFLWSLRRPTPKEKIEFPKEYENLEEVLPEGFLKRTSSIGKVIGWAPQMAVLSHPSVGGFVSHCGWNSTLESMWCGVPMAAWPLYAEQTLNAFLLVVELGLAAEIRMDYRTDTKAGYDGGMEVTVEEIEDGIRKLMSDGEIRNKVKDVKEKSRAAVVEGGSSYASIGKFIEHVSNVTI

SEQ ID NO: 215 - protein, 463 aa, Oryza sativa
MADSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVARNDGDGSFDREGVAAAIRAVAVEEESSKVFQAKAKKLQEIVADMACHERYIDGFIQQLRSYKD

SEQ ID NO: 216 - protein, 494 aa, Camelina sativa
MASEKTLQVHPPLHFVLFPFMAQGHMIPMVDIARLLAQRGATVTIVTTRYNAGRFENVLSRAVESGLPINIVHVKFPYEEVGLPKGKENIDSLDSMELMVPFFKAVNMLQDPVVKLMEEMESRPSCIISDLLLPYTSKIAKKFNIPKIVFHGISCFCLLCVHVLRRNLEILTNLKSDKEYFLVPSFPDRVEFTKPQVTVETNASGDWKEFLDEMVEAEDTSYGVIINTFEELEPAYVKDYKDARAGNVWSIGPVSLCNKAGVDKAERGNKATIDQDECLKWLDSKEEGSVLYVCLGSICNLPLVQLKELGLGLEESQRPFIWVIRGWEKYNELSEWMVESGFEERIRERGLLIRGWAPQVLILSHPSVGGFLTHCGWNSTVEGITSGVPLITWPLFGDQFCNQTLVVQVLKAGVSVGVEEVMKWGEEEKIGVLVDKEGVKKAVEDLMGESDDAKERTKRVKELGGLAHKAVEEGGSSHSNITLFLQDIRQVQSV

SEQ ID NO: 217 - protein, 478 aa, Glycyrrhiza uralensis
MADVAEEQPLKIYFIPYLAAGHMIPLCDIATLFASRGHHVTIITTPSNAQTLRESHHFRVQTIQFPSQEVGLPAGVQNLTAVTNLDDSYKIYHATMLLRKHIEDFVERDPPDCIVADFLFPWVDDVATKLHIPRLVFNGFTLFTICAMESHKAHPLPVDAASGSFVIPDFPHHVTINSTPPKRTKEFVDPLLTEAFKSHGFLINSFVELDGEECVEHYERITGGHKAWHLGPAFLVHRTAQDRGEKSVVSTQECLSWLDSKRDNSVLYICFGTICYFPDKQLYEIASAIEASGHEFIWVVPEKRGNADESEEEKEKWLPKGFEERNNGKKGMIIRGWAPQVAILGHPAVGGFLTHCGWNSTVEAVSAGVPMITWPVHSDQYFNEKLITQVRGIGVEVGAEEWIVTAFRETEKLVGRDRIERAVRRVMDGGDEAVQIRRRARELGEMARQAVQEGGSSHTNLTALINDLKRWRDSKQLN

SEQ ID NO: 218 - protein, 491 aa, Glycyrrhiza uralensis
MAVFQANQPHFVLFPLMAQGHIIPMIDIARLLAQRGAIVTIFTTPKNASRFTSVLSRAVSSGLQIRLVHLHFPSKEAGLPEGCENLDMVASHDMICNIFQAIRMLQKQAEELFETLTPKPSCIISDFCIPWTTQVAEKHHIPRISFHGFSCFCLHCMLKIHTSKVLEGITSESEYFTVPGIPDQIQVTKQQVPGPMIDEMKEFGEQMRDAEIRSYGVIINTFEELEKAYVNDYKKERNGKVWCIGPVSLCNKDGLDKAQRGNKASISEHHCLEWLDLQQPNSVIYVCLGSLCNLTPPQLMELALGLEATKRPFIWVIREGNKFEELEKWISEEGFEERIKGRGLIIRGWAPQVLILSHPSIGGFLTHCGWNSTLEGVTAGVPMVTWPLFADQFLNEKLVTQVLRIGVSLGVDVPLKWGEEEKVGVQVKKEGIEKAICMVMDEGEESKERRERAKELSEMAKRAVEKDGSSHLNMTMLIQDIMQQSSSKVET

SEQ ID NO: 219 - protein, 759 aa, Artemisia annua
MAWKLKIAEGGDPWLRTTNDHIGRQIWEFDPTLGSVEELAEIEKLRKTFRDNRFEKKHSADLLMRSQFAKENSVSVFPPKVNIKDVEDITEDKVTNVLRRAIGFHSTLQADDGHWPGDLGGPMFLLPGLVITLSITGALNAVLSKEHKREMCRYLYNHQNIDGGWGLHIEGHSTMFGSALNYVTLRLLGEGANDGEGAMEKGRKWILDHGGATAITSWGKFWLSVLGVFEWPGNNPLPPEMWLLPYFLPVHPGRMWCHCRMVYLPMSYLYGKRFVGPITSTVLALRKELFTVPYHDIDWNEARNLCAKEDLYYPHPLIQDVLWATLDKFVEPVLMSWPGKKLREKALRTAMEHIHYEDENTRYICIGPVNKVLNMLCCWVEDPNSEAFKLHLPRIQDYLWIAEDGMKMQGYNGSQLWDAAFTVQAIMSTNLIEEFGPTLKKGHIFIKKSQVLDNCYGDLDYWYRHISKGAWPFSTADHGWPISDCTAEGLKAALLLSKLPSEIVDEPLDAKRFYDAVNVILSLMNADGSFATYELTRSYSWLELINPAETFGDIVIDYPYVECTSAAIQALVAFKRLYPGHRRDEVQGCIDKAAAFLEKIQEADGSWYGSWAVCFTYGTWFGVKGLVAAGKNYSNCSSIRKACNFLLSKQLASGGWGESYLSCVDKVYTNLEGNRSHVVNTGWAMLALIDAEQAKRDPTPLHRAARVLINSQMENGEFPQQEIMGVFNRNCMITYAAYRNIFPIWALGEYRCRVLKVET

SEQ ID NO: 220 - protein, 765 aa, Citrullus colocynthis
MAWRLKVGAESVGEKEEKWLKSISNHLGRQVWEFCAHQPTASPNHLQQIDNARNHFRNNRFHRKQSSDLFLAIQNEKEIANVTKGGGIKVKEEEDVRKETVKNTVERALSFYSAIQTNDGNWASDLGGPMFLLPGLVIALYVTGVLNSVLSKHHRQEMCRYLYNHQNEDGGWGLHIEGTSTMFGSALNYVALRLLGEDADGGEGGAMTKARSWILDRGGATAITSWGKLWLSVLGVYEWSGNNPLPPEFWLLPYCLPFHPGRMWCHCRMVYLPMSYLYGKRFVGPITPIVLSLRKELYTIPYHEIDWNRSRNTCAKEDLYYPHPKMQDILWGSIYHLYEPLFTRWPGKRLREKALQMAMKHIHYEDENSRYICLGPVNKVLNMLCCWVEDPYSDAFKFHLQRVPDYLWVAEDGMRMQGYNGSQLWDTAFSVQAIISTKLIDSFGTTLKKAHDFVKDSQIQQDCPGDPNVWFRHIHKGAWPFSTRDHGWLISDCTAEGLKASLMLSKLPSKIVGEPLEKSRLCDAVNVLLSLQNENGGFASYELTRSYPWLELINPAETFGDIVIDYPYVECTSATMEALTLFKKLHPGHRTKEIDIAVARAANFLENMQRTDGSWYGCWGVCFTYAGWFGIKGLVAAGRTYNSCVAIRKACDFLLSKELPGGGWGESYLSCQNKVYTNLEGNRPHLVNTAWVLMALIEAGQAERDPAPLHRAARLLINSQLENGDFPQEEIMGVFNKNCMITYAAYRNIFPIWALGEYFHRVLTE

SEQ ID NO: 221 - protein, 520 aa, Siraitia grosvenorii
MEMSSSVAATISIWMVVVCIVGVGWRVVNWVWLRPKKLEKRLREQGLAGNSYRLLFGDLKERAAMEEQANSKPINFSHDIGPRVFPSMYKTIQNYGKNSYMWLGPYPRVHIMDPQQLKTVFTLVYDIQKPNLNPLIKFLLDGIVTHEGEKWAKHRKIINPAFHLEKLKDMIPAFFHSCNEIVNEWERLISKEGSCELDVMPYLQNLAADAISRTAFGSSYEEGKMIFQLLKELTDLVVKVAFGVYIPGWRFLPTKSNNKMKEINRKIKSLLLGIINKRQKAMEEGEAGQSDLLGILMESNSNEIQGEGNNKEDGMSIEDVIEECKVFYIGGQETTARLLIWTMILLSSHTEWQERARTEVLKVFGNKKPDFDGLSRLKVVTMILNEVLRLYPPASMLTRIIQKETRVGKLTLPAGVILIMPIILIHRDHDLWGEDANEFKPERFSKGVSKAAKVQPAFFPFGWGPRICMGQNFAMIEAKMALSLILQRFSFELSSSYVHAPTVVFTTQPQHGAHIVLRKL

SEQ ID NO: 222 - protein, 417 aa, Homo sapiens
MEFVKCLGHPEEFYNLVRFRIGGKRKVMPKMDQDSLSSSLKTCYKYLNQTSRSFAAVIQALDGEMRNAVCIFYLVLRALDTLEDDMTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 223 - protein, 516 aa, Homo sapiens
MLEFHFEGEEQPLSMMKKFLKSSWVRIGFVPEEERNVLRRRKGTNISETSLIGTAACTSTSSQNDPEVIIVGAGVLGSALAAVLSRDGRKVTVIERDLKEPDRIVGEFLQPGGYHVLKDLGLGDTVEGLDAQVVNGYMIHDQESKSEVQIPYPLSENNQVQSGRAFHHGRFIMSLRKAAMAEPNAKFIEGVVLQLLEEDDVVMGVQYKDKETGDIKELHAPLTVVADGLFSKFRKSLVSNKVSVSSHFVGFLMKNAPQFKANHAELILANPSPVLIYQISSSETRVLVDIRGEMPRNLREYMVEKIYPQIPDHLKEPFLEATDNSHLRSMPASFLPPSSVKKRGVLLLGDAYNMRHPLTGGGMTVAFKDIKLWRKLLKGIPDLYDDAAIFEAKKSFYWARKTSHSFVVNILAQALYELFSATDDSLHQLRKACFLYFKLGGECVAGPVGLLSVLSPNPLVLIGHFFAVAIYAVYFCFKSEPWITKPRALLSSGAVLYKACSVIFPLIYSEMKYMVH

The invention claimed is:

1. A method for making mogrol or mogroside, comprising:
providing a recombinant microbial host cell expressing a heterologous enzyme pathway catalyzing the conversion of isopentenyl pyrophosphate (IPP) and dimethylallyl pyrophosphate (DMAPP) to mogrol or mogroside, the heterologous enzyme pathway comprising:
a farnesyl diphosphate synthase (FPPS),
a squalene synthase (SQS),
a squalene epoxidase (SQE) catalyzing the formation of 2,3;22,23-dioxidosqualene from squalene,
a triterpene cyclase (TTC) catalyzing the formation of 24,25-epoxycucurbitadienol from 2,3;22,23-dioxidosqualene,
an epoxide hydrolase (EPH) catalyzing the formation of 24,25-dihydroxycucurbitadienol from 24,25-epoxycucurbitadienol, and
a cytochrome P450 enzyme catalyzing the formation of mogrol from 24,25-dihydroxycucurbitadienol;
wherein the cytochrome P450 enzyme comprises an amino acid sequence having at least 85% sequence identity with SEQ ID NO: 171; and
culturing the host cell under conditions for producing the mogrol or mogroside.

2. The method of claim 1, wherein the squalene epoxidase comprises an amino acid sequence that is at least 90% identical to SEQ ID NO: 39.

3. The method of claim 1, wherein the SQS comprises an amino acid sequence that is at least 90% identical to an amino acid sequence selected from SEQ ID NOS: 2 to 16, 166, and 167.

4. The method of claim 1, wherein the TTC comprises an amino acid sequence that is at least 90% identical to an amino acid sequence selected from SEQ ID NOS: 40, 191, 192, and 193.

5. The method of claim 4, wherein the TTC comprises an amino acid sequence that is at least 90% identical to the amino acid sequence of SEQ ID NO: 40.

6. The method of claim 1, wherein the heterologous enzyme pathway comprises at least one TTC that comprises an amino acid sequence that is at least 90% identical to one of SEQ ID NO: 191, SEQ ID NO: 192, and SEQ ID NO: 193.

7. The method of claim 1, wherein the EPH comprises an amino acid sequence that is at least 90% identical to one of: SEQ ID NOS: 189, 58, 184, 185, 187, 188, 190, and 212.

8. The method of claim 1, wherein the cytochrome P450 comprises an amino acid sequence that is at least 90% identical to the amino acid sequence of SEQ ID NO: 171.

9. The method of claim 1, wherein the heterologous enzyme pathway further comprises one or more uridine diphosphate-dependent glycosyltransferase (UGT) enzymes, thereby producing one or more mogrol glycosides.

10. The method of claim 9, wherein the one or more mogrol glycosides are selected from Mog.II-E, Mog.III, Mog.III-A1, Mog.III-A2, Mog.III, Mog.IV, Mog.IV-A, siamenoside, Mog.V, and Mog.VI.

11. The method of claim 9, wherein at least one uridine diphosphate dependent glycosyltransferase (UGT) enzyme comprises an amino acid sequence having at least 90% sequence identity to one of SEQ ID NO: 164, 165, 138, 204 to 211, and 213 to 218.

12. The method of claim 11, wherein at least one UGT enzyme further comprises an amino acid sequence that is at least 90% identical to SEQ ID NO: 146.

13. The method of claim 11, wherein at least one UGT enzyme further comprises an amino acid sequence that is at least 90% identical to SEQ ID NO: 202.

14. The method of claim 11, wherein the microbial host cell expresses at least three UGT enzymes: a first UGT enzyme catalyzing primary glycosylation at the C24 hydroxyl of mogrol, a second UGT enzyme catalyzing primary glycosylation at the C3 hydroxyl of mogrol, and a third UGT enzyme catalyzing one or more branching glycosylation reactions.

15. The method of claim 1, wherein the microbial host cell is a bacterium selected from *Escherichia coli, Bacillus subtilis, Corynebacterium glutamicum, Rhodobacter capsulatus, Rhodobacter sphaeroides, Zymomonas mobilis, Vibrio natriegens*, or *Pseudomonas putida*; or is a yeast selected from *Saccharomyces cerevisiae, Pichia pastoris*, and *Yarrowia lipolytica*.

16. The method of claim 1, wherein the mogrol glycoside products are recovered from the extracellular media.

17. A method for making a product comprising a mogrol glycoside, comprising:
producing a mogrol glycoside in accordance with claim 1, and incorporating the mogrol glycoside into a product.

18. A microbial host cell expressing a heterologous enzyme pathway catalyzing the conversion of isopentenyl pyrophosphate (IPP) and dimethylallyl pyrophosphate (DMAPP) to mogrol or mogroside, the heterologous enzyme pathway comprising:
a farnesyl diphosphate synthase (FPPS),
a squalene synthase (SQS),
a squalene epoxidase (SQE) catalyzing the formation of 2,3;22,23-dioxidosqualene from squalene,
a triterpene cyclase (TTC) catalyzing the formation of 24,25-epoxycucurbitadienol from 2,3;22,23-dioxidosqualene,
an epoxide hydrolase (EPH) catalyzing the formation of 24,25-dihydroxycucurbitadienol from 24,25-epoxycucurbitadienol, and
a cytochrome P450 enzyme catalyzing the formation of mogrol from 24,25-dihydroxycucurbitadienol;
wherein the cytochrome P450 enzyme comprises an amino acid sequence having at least 85% sequence identity with SEQ ID NO: 171.

19. The method of claim 1, wherein the microbial host cell further comprises a cytochrome P450 reductase enzyme.

20. The method of claim 18, wherein the microbial host cell further comprises a cytochrome P450 reductase enzyme.

* * * * *